US008372801B2

(12) United States Patent
Roosild et al.

(10) Patent No.: US 8,372,801 B2
(45) Date of Patent: Feb. 12, 2013

(54) COMPOSITIONS AND METHODS FOR PRODUCING RECOMBINANT PROTEINS

(75) Inventors: Tarmo Roosild, Las Vegas, NV (US); Jason Greenwald, Zurich (CH); Senyon Choe, Solana Beach, CA (US)

(73) Assignee: The Salk Institute for Biological Studies, La Jolla, CA (US)

( * ) Notice: Subject to any disclaimer, the term of this patent is extended or adjusted under 35 U.S.C. 154(b) by 598 days.

(21) Appl. No.: 12/540,852

(22) Filed: Aug. 13, 2009

(65) Prior Publication Data

US 2010/0036096 A1 Feb. 11, 2010

Related U.S. Application Data

(63) Continuation of application No. 11/317,847, filed on Dec. 22, 2005, now Pat. No. 7,612,186.

(60) Provisional application No. 60/639,174, filed on Dec. 22, 2004.

(51) Int. Cl.
*C07K 14/00* (2006.01)
*C12N 1/20* (2006.01)

(52) U.S. Cl. ............ 514/2; 530/300; 435/252.1

(58) Field of Classification Search .................. None
See application file for complete search history.

(56) References Cited

U.S. PATENT DOCUMENTS

| 5,143,846 | A | 9/1992 | Huala et al. |
| 5,264,365 | A | 11/1993 | Georgiou et al. |
| 5,264,366 | A | 11/1993 | Ferrari et al. |
| 5,508,192 | A | 4/1996 | Georgiou et al. |
| 5,587,455 | A | 12/1996 | Berger et al. |
| 5,668,255 | A | 9/1997 | Murphy |
| 5,696,237 | A | 12/1997 | FitzGerald et al. |
| 5,821,082 | A | 10/1998 | Chinnadurai |
| 5,834,209 | A | 11/1998 | Korsmeyer |
| 5,888,732 | A | 3/1999 | Hartley et al. |
| 6,143,557 | A | 11/2000 | Hartley et al. |
| 6,171,861 | B1 | 1/2001 | Hartley et al. |
| 6,270,969 | B1 | 8/2001 | Hartley et al. |
| 6,277,608 | B1 | 8/2001 | Hartley et al. |
| 6,720,140 | B1 | 4/2004 | Hartley et al. |

FOREIGN PATENT DOCUMENTS

| WO | WO 88/05821 | 8/1988 |
| WO | WO 98/12328 | 3/1998 |
| WO | WO 98/17682 | 4/1998 |
| WO | WO 2004/015111 | 2/2004 |

OTHER PUBLICATIONS

Baneyx and Georgiou, "In vivo degradation of secreted fusion proteins by the *Escherichia coli* outer membrane protease OmpT," *J. Bacteriol.*, 172:491-494, 1990.
Battiste and Wagner, "Utilization of site-directed spin labeling and high-resolution heteronuclear nuclear magnetic resonance for global fold determination of large proteins with limited nuclear overhauser effect data," *Biochemistry*, 39:5355-5365, 2000.
Berman et al., "The Protein Data Bank," *Nucleic Acids Research*, 28:235-242, 2000.
Chaudhury and Smith, "*Escherichia coli* recBC deletion mutants," *J. Bacteriol.*, 160:788-791, 1984.
Derst and Karschin, "Evolutionary link between prokaryotic and eukaryotic K+ channels," *J. Exp. Biol.*, 201:2791-2799, 1998.
Elish, et al., "Biochemical analysis of spontaneous fepA mutants of *Escherichia coli*," *J. Gen. Microbiol.*, 134:1355-1364, 1988.
Grzesiek and Bax, "A three-dimensional NMR experiment with improved sensitivity for carbonyl-carbonyl J correlation in proteins," *J. Biomol. NMR*, 9:207-211, 1997.
Güntert et al., "Sequence-specific NMR assignment of proteins by global fragment mapping with the program MAPPER," *J. Biomol. NMR*, 18:129-137, 2000.
Güntert, "Automated NMR structure calculation with CYANA," *Methods Mol. Biol.*, 278:353-378, 2004.
Hanahan et al. "Plasmid transformation of *Escherichia coli* and other bacteria," *Meth. Enzymol.*, 204:63-113, 1991.
Hanes and Plückthun, "In vitro selection and evolution of functional proteins by using ribosome display" *Proc. Natl. Acad. Sci. USA*, 94:4937-4942, 1997.
Hilty et al., "Membrane protein-lipid interactions in mixed micelles studied by NMR spectroscopy with the use of paramagnetic reagents," *Chembiochem*, 5:467-473, 2004.
Kiefer et al., "Bacterial expression of G-protein-coupled receptors: prediction of expression levels from sequence," *Receptors & Channels*, 7:109-119, 2000.
Kobertz et al., "Hanging gondola structure of the T1 domain in a voltage-gated K+ channel," *Biochem.*, 39:10347-10352, 2000.
Kosen, "Spin labeling of proteins," *Methods Enzymol.*, 177:86-121, 1989.
Laage et al., "Strategies for prokaryotic expression of eukaryotic membrane proteins," *Traffic*, 2(2):99-104, 2001.
Lawler et al., "A rapid and efficient method for the radiosynthesis and purification of [$^{125}$I]SCH23982," *J. Neurosci. Meth.*, 49:141-53, 1993.
McIntosh, et al., "Genetic and physiological studies on the relationship between colicin B resistance and ferrienterochelin uptake in *Escherichia coli* K-12," *J. Bacteriol.*, 137:653-657, 1979.
Needleman and Wunsch, "A general method applicable to the search for similarities in the amino acid sequence of two proteins," *J. Mol. Biol.* 48:443-453, 1970.
Noren et al., "A general method for site-specific incorporation of unnatural amino acids into proteins," *Science*, 244:182-188, 1989.
Oudega et al., "Analysis of the *Bacillus subtilis* genome: cloning and nucleotide sequence of a 62 kb region between 275° (rrnB) and 284° (pai)", *Microbiology*, 143:2769-2774, 1997.

(Continued)

*Primary Examiner* — Anand Desai
(74) *Attorney, Agent, or Firm* — Klarquist Sparkman, LLP

(57) ABSTRACT

A class of integral membrane proteins, referred to as Mistic polypeptides, their variants, fusion proteins including a Mistic polypeptide domain, and nucleic acid molecules encoding Mistic polypeptides and Mistic fusion proteins are disclosed herein. Also described are methods of using Mistic polypeptides and Mistic fusion proteins to produce and/or isolate recombinant proteins (including without limitation classes of eukaryotic proteins that have previously been intractable to recombinant bacterial expression, such as, eukaryotic integral membrane proteins).

18 Claims, 16 Drawing Sheets

OTHER PUBLICATIONS

Pervushin et al., "Attenuated T2 relaxation by mutual cancellation of dipole-dipole coupling and chemical shift anisotropy indicates an avenue to NMR structures of very large biological macromolecules in solution," *Proc. Natl. Acad. Sci. USA*., 94:12366-12371, 1997.

Ramamurthy and Oliver, "Topology of the integral membrane form of *Escherichia coli* SecA protein reveals multiple periplasmically exposed regions and modulation by ATP binding ," *J. Biol. Chem.*, 272:23239-23246, 1997.

Riek et al., "Solution NMR techniques for large molecular and supramolecular structures," *J. Am. Chem. Soc.*, 124:12144-12153, 2002.

Ritter et al., "3D TROSY-HNCA(coded)CB and TROSY-HNCA(coded)CO experiments: triple resonance NMR experiments with two sequential connectivity pathways and high sensitivity," *J. Biomol. NMR*, 28:289-294, 2004.

Roosild, et al., "NMR structure of Mistic, a membrane-integrating protein for membrane protein expression," *Science*, 307:1317-1321, 2005.

Salzmann et al., "Improved sensitivity and coherence selection for [15N,1H]-TROSY elements in triple resonance experiments," *J. Biomol. NMR*, 15:181-184, 1999.

Schatz and Dobberstein, "Common principles of protein translocation across membranes," *Science*, 271:1519-1526, 1996.

Tate, "Overexpression of mammalian integral membrane proteins for structural studies," *FEBS Letters*, 504:94-98, 2001.

Tucker et al., "Purification of a rat neurotensin receptor expressed in *Escherichia coli*," *Biochem. J.*, 317:891-899, 1996.

Veith et al., "The complete genome sequence of *Bacillus licheniformis* DSM13, an organism with great industrial potential," *J. Mol. Microbiol. Biotechnol.*, 7:204-211, 2004.

Wimley and White, "Designing transmembrane alpha-helices that insert spontaneously," *Biochem.*, 39:4432-4442, 2000.

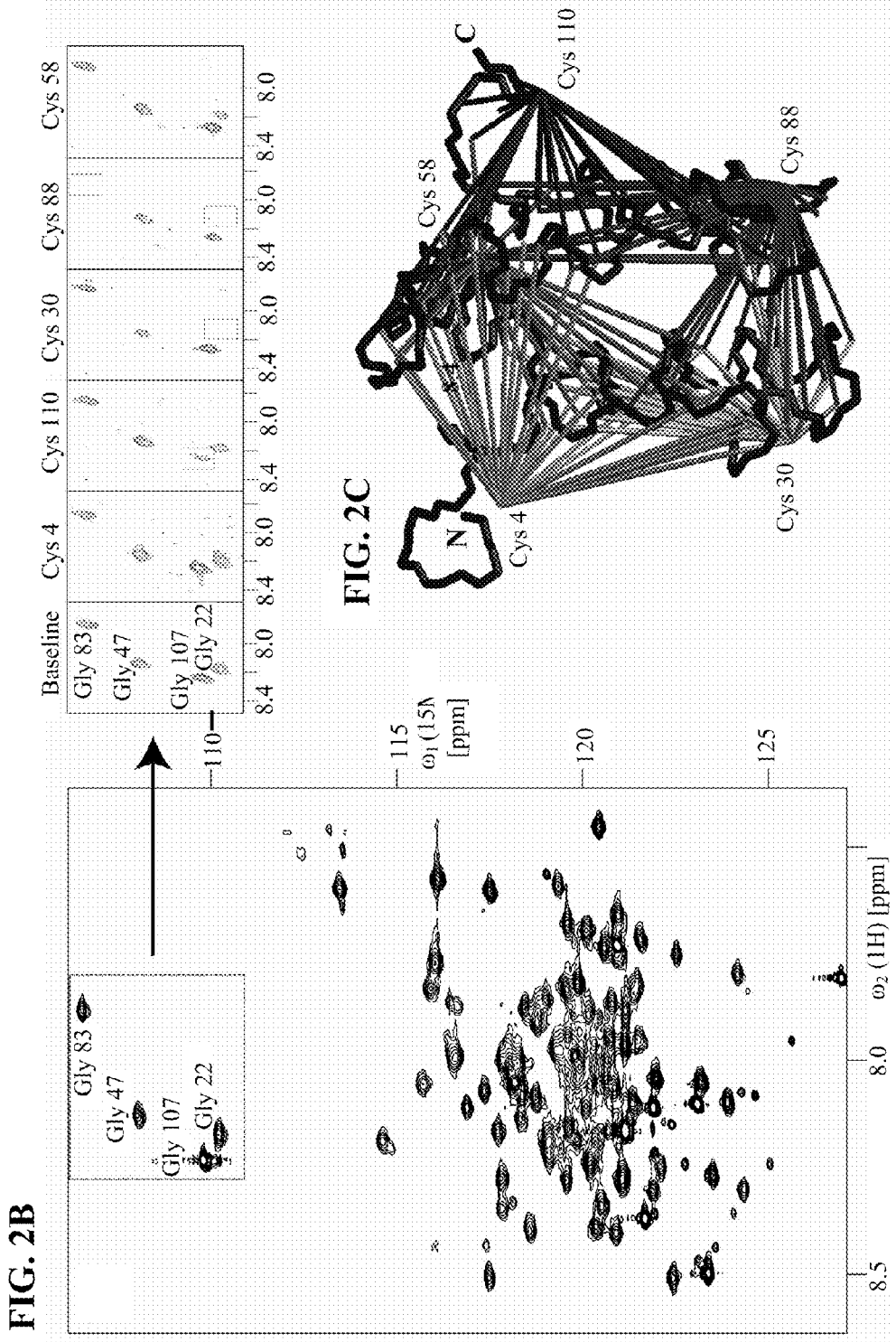

A

D

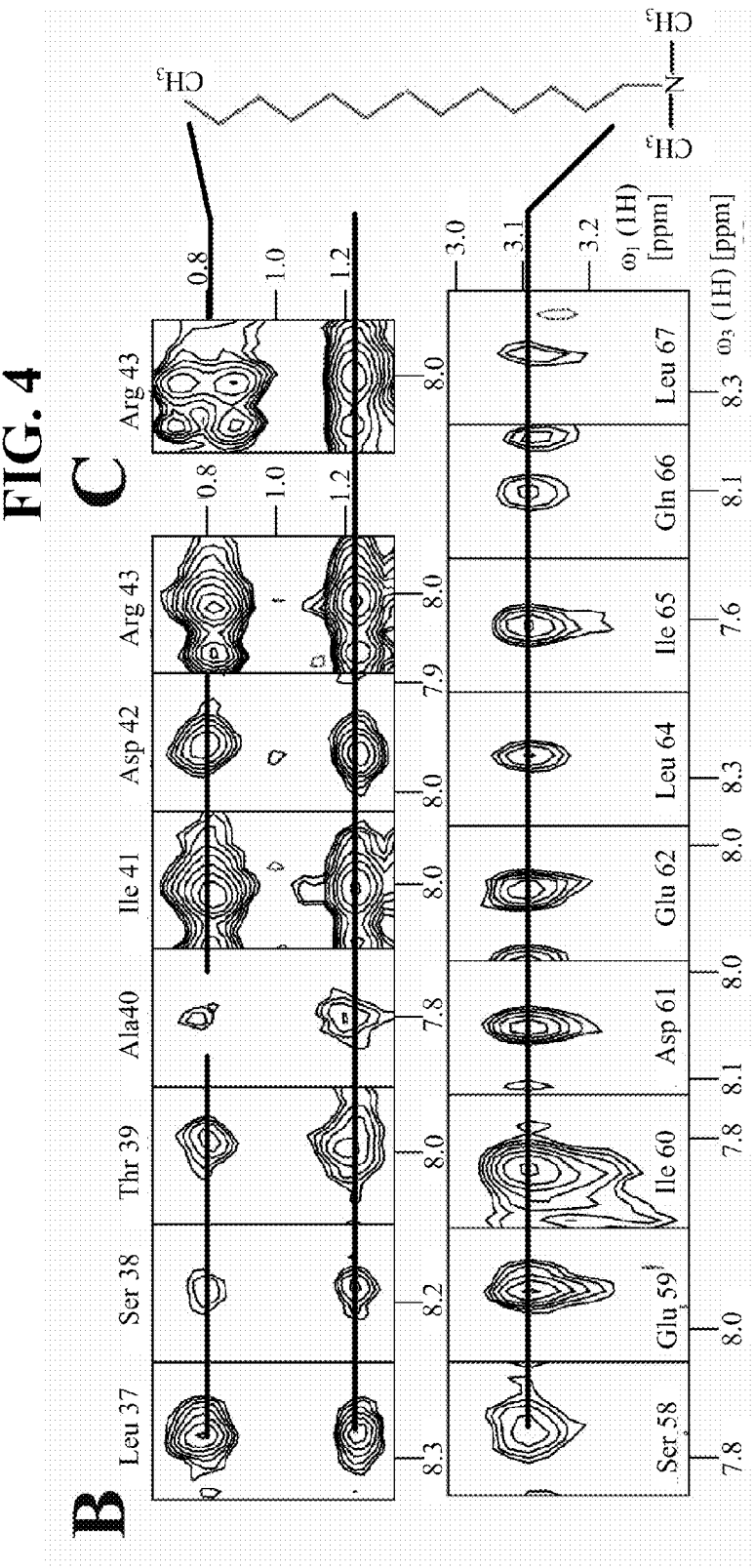

GPCR    TGFβ    Kv

RAI3    CRFR 2b    ActR IIb    BMPR II    aKv1.1

FIG. 15

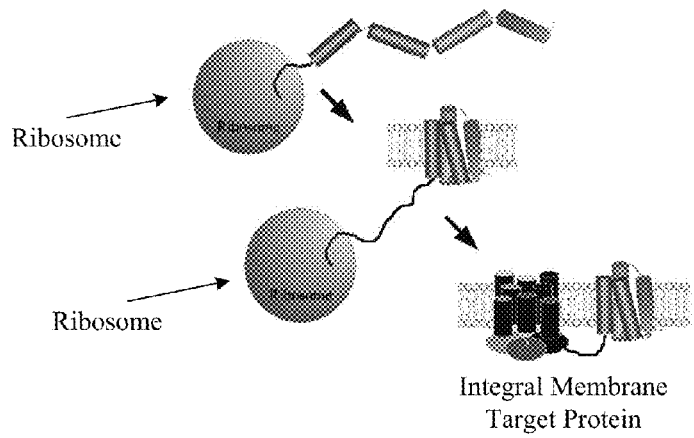

Schematic I:

Ribosome

Ribosome

Integral Membrane Target Protein

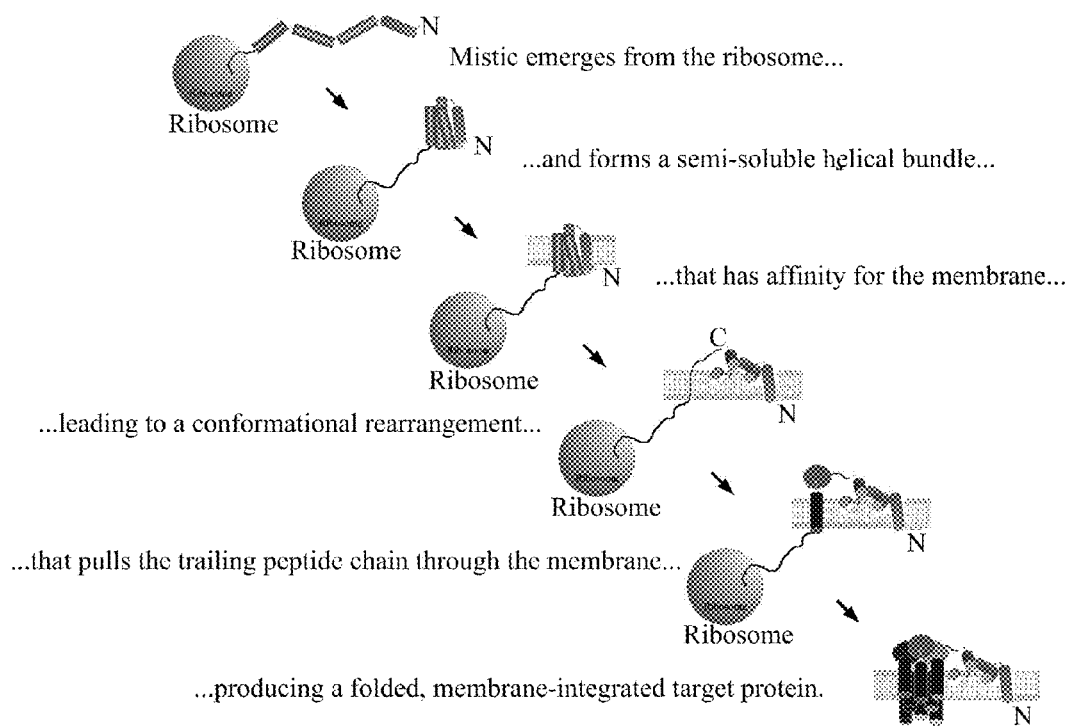

Schematic II:

Mistic emerges from the ribosome...

Ribosome

...and forms a semi-soluble helical bundle...

Ribosome

...that has affinity for the membrane...

Ribosome

...leading to a conformational rearrangement...

Ribosome

...that pulls the trailing peptide chain through the membrane...

Ribosome

...producing a folded, membrane-integrated target protein.

COMPOSITIONS AND METHODS FOR PRODUCING RECOMBINANT PROTEINS

CROSS REFERENCE TO RELATED APPLICATIONS

This application is a continuation of U.S. application Ser. No. 11/317,847, filed Dec. 22, 2005, now U.S. Pat. No. 7,612, 186, which claims the benefit of U.S. Provisional Application No. 60/639,174, filed Dec. 22, 2004. Both applications are incorporated herein in their entirety.

STATEMENT OF GOVERNMENT SUPPORT

This invention was made with United States government support pursuant to grant GM 56653 from the National Institutes of Health. The United States government has certain rights in the invention.

FIELD OF THE DISCLOSURE

This disclosure relates to membrane-associating proteins, including fusion proteins thereof, and to nucleic acid sequences encoding such proteins. Methods of using the disclosed proteins (including fusion proteins) and corresponding nucleic acid sequences are also disclosed.

BACKGROUND

The vast numbers of candidate proteins generated from genomics programs are creating enormous opportunities in the biotechnology sector. However, efficient and rapid expression of genes in homologous and heterologous expression systems, and high-level expression and efficient isolation of proteins encoded by such genes are often major bottlenecks. In many circumstances, the practical and/or cost-effective expression of recombinant proteins in amounts large enough to allow for subsequent characterization and evaluation is prohibitive. Expression and isolation of recombinant integral membrane (IM) proteins provide one of many examples.

IM proteins constitute nearly 30% of all open reading frames in fully sequenced eukaryotic genomes. They play central roles in living cells with respect to transport processes, intercellular signaling, and regulation of cell growth. Under native conditions, eukaryotic IM proteins are synthesized and integrated cotranslationally into the membrane of the endoplasmic reticulum (ER) through an aqueous hole known as the translocon (Schatz and Dobberstein, *Science,* 271(5255): 1519-1526, 1996). Eukaryotic membrane proteins are usually expressed at low levels and they are often modified (N- and O-glycosylation, palmitoylation, prenylation, myristolation, GPI-modification, protease cleavage) inside the ER lumen. Within the ER lumen, disulfide bonds also can be formed as part of the folding process by a set of disulfide reductases and oxidases.

In principle, both prokaryotic and eukaryotic expression systems can be used for heterologous expression of eukaryotic IM proteins. A variety of expression hosts have been explored for this purpose, including *Escherichia coli, Halobacterium, Lactococcus lactis, Saccharomyces cerevisiae, Schizosaccharomyces pombe, Pichia pastoris,* baculovirus-infected Sf9 insect cells, mammalian cell lines transfected stably or transiently by expression vectors, and easily grown small animals. Traditionally, bacterial expression hosts, such as *E. coli,* have been the preferred platform for heterologous high-level expression of recombinant proteins for biochemical and structural research. The reasons for the popularity of these organisms include culture affordability, ease of genetic manipulation, and high yields of desired product. However, the application of this platform to IM proteins has met with limited success.

At least two complications arise with the production of IM proteins in bacteria. First, unlike soluble proteins, IM proteins must be trafficked to the membrane, involving targeting signals that may not be recognized by the machinery within the bacterial host. Second, even in cases where a signal sequence is discernable, high-level production of membrane proteins in *E. coli* can competitively exclude production of other vital membrane proteins in the *E. coli,* leading to toxicity. For this reason, traditional methods of IM protein expression in bacteria have utilized low copy-number plasmids with weak promoters that produce low levels of protein, compensated by extremely large culture volumes (Laage and Langosch, *Traffic,* 2:99-104, 2001). Alternatively, IM proteins can be purposefully targeted to bacterial inclusion bodies (Kiefer et al., *Receptors Channels,* 7:109-119, 2000). This process necessitates subsequent renaturation of the desired IM protein from these insoluble deposits, which is fraught with empirical difficulties and limited success rates. Both of these options fundamentally limit the application of traditional bacterial methods to production of high levels of recombinant IM proteins in their native conformations.

While fusion partner proteins have been used to assist in the successful production of soluble recombinant proteins, traditional fusion partners have not been useful in the production of IM proteins (Tucker and Grisshammer, *Biochem J.,* 317:891-899, 1996). None of the currently available fusion proteins (e.g., glutathione-S-transferase, maltose binding protein, or thioredoxin) target the construct to the membrane and facilitate membrane insertion.

Compositions and methods that facilitate the production and isolation of recombinant proteins in heterologous expression systems are needed.

SUMMARY OF THE DISCLOSURE

This disclosure describes compositions and methods that further the goal of producing and/or isolating proteins (such as, eukaryotic IM proteins) in heterologous expression systems (such as, prokaryotic expression systems, like *E. coli*). For example, described is a newly discovered class of polypeptides that associate with a membrane (such as, a bacterial cell membrane) when expressed alone or as a chimera with a fusion partner (such as, an eukaryotic IM proteins). This class of polypeptides is referred to as Mistic polypeptides, where "Mistic" is an acronym for Membrane Integrating Sequence for Translation of IM protein Constructs. Amino acid sequences of, and nucleic acid sequences encoding, Mistic polypeptides and their variants (including, e.g., functional fragments), and methods of using the same (for example, to produce and/or isolate recombinant proteins) are disclosed herein.

The foregoing and other features and advantages will become more apparent from the following detailed description, which proceeds with reference to the accompanying figures.

BRIEF DESCRIPTION OF THE FIGURES

FIG. 1A shows the primary sequence of Mistic-L (SEQ ID NO: 2). Wild-type Cys 3 and residues mutated to cysteine for probing Mistic-L's orientation in the membrane are shown in outline, and residues mutated in structural disruption mutants are boxed. The secondary structural boundaries of Mistic-L are illustrated beneath the primary sequence. FIG. 1B shows an SDS-PAGE gel of Ni-NTA-eluted proteins present in the indicated fractions of a culture recombinantly expressing octa-histidine tagged Mistic-L. FIG. 1C shows a graph of multi-angle static light scattering results for Mistic-L in 3 mM lauryl-dimethylamine oxide (LDAO). FIG. 1D shows a nitrocellulose blot of biotinylated proteins isolated by Ni-NTA chromatography from 3-(N-maleimido-propinyl) biocytin (MPB)-labeled right-side-out vesicles from cells expressing wild-type Mistic-L (Cys3(Wt)) or the indicated Mistic-L mutants (with Cys3 mutated to Val).

FIG. 2 includes three panels (A-C) describing the secondary structure and long-range interactions of Mistic-L (SEQ ID NO: 222). FIG. 2A, second and third lines show NOEs observed in the $^{15}$N-resolved TROSY-[$^1$H, $^1$H]-NOESY. Thin, medium and thick bars represent weak (4.5 to 5.5 Å), medium (3 to 4.5 Å) and strong (<3 Å) sequential NOEs ($d_{NN}(i,i+1)$). The medium-range NOEs $d_{NN}(i,i+2)$ are shown by lines starting and ending at the positions of the residues related by the NOE. FIG. 2A, fourth and fifth lines show deviation of the $^{13}C^\alpha$ chemical shifts from corresponding 'random coil' chemical shifts in 0 mM $K^+$ (solid) and 100 mM $K^+$ (outline), as independently assigned. Values larger than 1.5 ppm are indicative of an α-helical secondary structure, values smaller than −1.5 ppm are indicative of β-sheet secondary structure. FIG. 2B shows the 2D [$^{15}$N, $^1$H]-TROSY spectrum of Mistic-L along with parts of the 2D [$^{15}$N, $^1$H]-TROSY spectra in presence of paramagnetic spin-labels at positions Cys3, Thr30Cys, Ser58Cys, Asn88Cys, and Glu110Cys. Comparison of peaks heights between perturbed spectra and multiple reference spectra was used to obtain long-range distance restraints. FIG. 2C shows the collected upper limit long-range restraints mapped to the structure of Mistic-L.

FIG. 3A illustrates the superposition of 10 conformers representing the final Mistic-L NMR structure. The bundle is obtained by superimposing the backbone $C^\alpha$ carbons of residues 13-62 and 67-102. FIG. 3B is a ribbon diagram of the lowest energy conformer highlighting the four α-helix bundle. FIG. 3C is a surface representation of Mistic-L, oriented as in FIG. 3B, mapping electrostatic potential. Positive charges are shown hatched, negative charges are shown in striped grey, and neutral surface is shown in white. FIG. 3D is a representation of the residues forming the core of Mistic-L. Residues mutated in structural disruption studies are designated by arrows. FIG. 3E is a schematic representation of a top view of Mistic-L from the intracellular side of the membrane. FIG. 3F is a surface representation of the electrostatic potential of Mistic-L, viewed from the opposite face from that shown in FIG. 3C.

FIG. 4A is a surface representation of Mistic-L indicating observed NOE interactions between detergent molecules and the protein. Interactions observed between the head methyl ($CH_3$) groups of LDAO and backbone amides ($^1H_N$) of the protein are shown in light grey; interactions observed between the hydrophobic $CH_3$ end of LDAO and $^1H_N$ of the protein are shown in striped grey, and interactions observed between the LDAO chain ($CH_2$) and $^1H_N$ are shown hatched. FIG. 4B shows a selection of intermolecular NOEs between LDAO and residues 37-43 and 58-67 of Mistic-L. $^{15}$N, $^1$H strips from the $^{15}$N-resolved TROSY [$^1$H, $^1$H]-NOESY are shown. For the differentiation between intramolecular and intermolecular NOEs, a second NOESY experiment was measured without decoupling on $^{13}$C during $^1$H evolution, that yielded doublets for protein-protein NOEs, but single peaks for detergent-protein NOEs. Arg43 for this measurement is shown in FIG. 4C in comparison with Arg43 in FIG. 4B showing the presence of a protein-protein NOE at 0.8 ppm and the presence of a detergent-protein NOE at 1.2 ppm. FIG. 4D is a surface representation of Mistic-L indicating TROSY perturbations by a hydrophobically partitioning probe (striped grey) and a hydrophilically partitioning probe (dark grey). Residues that exhibited at least a 40% drop in $^1H_N$ peak area are indicated.

FIG. 5A are topological depictions of three protein classes fused to Mistic-L as disclosed herein: G-protein coupled receptors (GPCR); TGF-β family receptors; and voltage-gated $K^+$ channels (Kv). FIG. 5B shows a series of SDS-PAGE gels of proteins captured by Ni-NTA affinity chromatography from LDAO-solubilized membrane fractions of cells expressing a fusion protein comprising Mistic-L and the indicated eukaryotic IM protein (RAI3, CRFR2b, ActR IIb, BMPR II, or aKv1.1). The Mistic-L-fused protein (open arrow) is shown in the left lane of each set and the final product (solid arrow) after removal of Mistic-L by thrombin digestion is shown in the right lane of each set.

FIGS. 8A and B show Mistic-L fused to truncated (i.e., lacking intracellular T1 and C-terminal domains) and wild-type aKv1.1, respectively.

FIG. 9B shows another Gateway™-adapted Mistic polypeptide fusion vector, which includes additional features as compared to pMis2.1 and pMisT2.1, including a C-terminal affinity tag utilizing a TEV protease cleavage motif enabling flexibility in purification strategies and additional open reading frame(s) (e.g., "Protein 2") to allow di-cistronic protein expression. Specific non-limiting examples of pMis2.1 and pMisT2.1 including a Mistic-L domain are described; however, it is understood that any Mistic polypeptide (e.g., Mistic-L, M1, M2, M3, or M4) can serve as a "Mistic" domain in the exemplary vectors.

FIG. 15 shows two schematic representations of proposed, non-limiting models of Mistic polypeptide function.

SEQUENCE LISTING

Figure 1:
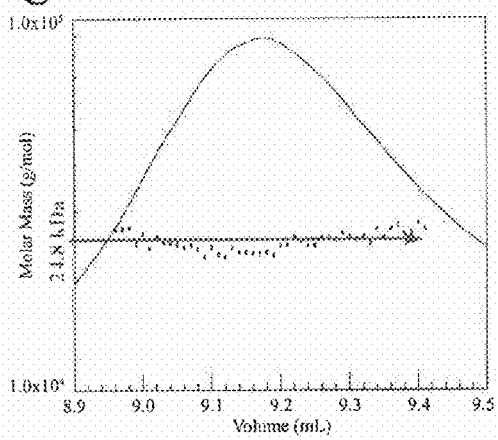
FIG. 1 includes four panels (A-D) demonstrating various features of Mistic-L.
Figure 1:
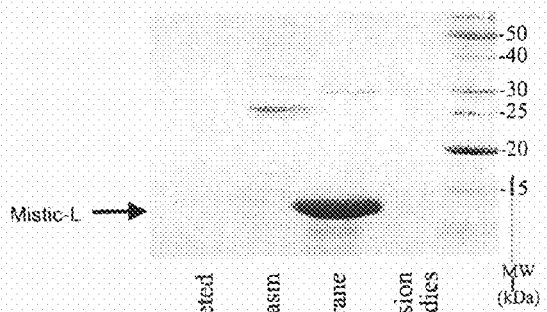
Figure 1:
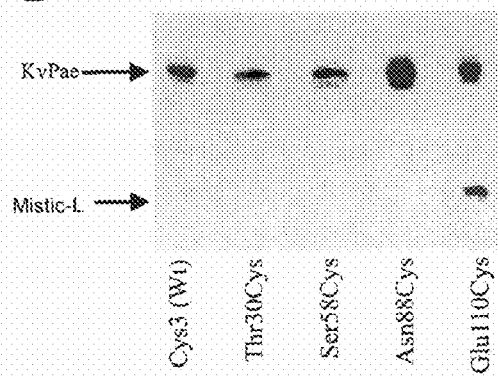

The nucleic and amino acid sequences listed in the accompanying sequence listing are shown using standard letter abbreviations for nucleotide bases, and three letter code for amino acids, as defined in 37 C.F.R. 1.822. Only one strand of each nucleic acid sequence is shown, but the complementary strand is understood as included by any reference to the displayed strand. Amino acid mutations and the corresponding positions are shown in parentheses using standard one-letter amino acid designations (unless expressly stated otherwise). In the accompanying sequence listing:

SEQ ID NO: 1 shows a *B. subtilus* wild-type Mistic-L nucleic acid sequence.

SEQ ID NO: 2 shows a *B. subtilus* wild-type Mistic-L amino acid sequence.

SEQ ID NO: 3 shows a nucleic acid sequence of pMistic, which encodes an octa-histidine domain (residues 1-60) fused to a *B. subtilus* wild-type Mistic-L domain (residues 61-390).

SEQ ID NO: 4 shows an amino acid sequence of pMistic.

SEQ ID NO: 5 shows a nucleic acid sequence of pMistic (W13A).

SEQ ID NO: 6 shows an amino acid sequence of pMistic (W13A).

SEQ ID NO: 7 shows a nucleic acid sequence of pMistic (Q36E).

SEQ ID NO: 8 shows an amino acid sequence of pMistic (Q36E).

SEQ ID NO: 9 shows a nucleic acid sequence of pMistic (M75A).

SEQ ID NO: 10 shows an amino acid sequence of pMistic (M75A).

SEQ ID NO: 11 shows a nucleic acid sequence of pMistic (C3V).

SEQ ID NO: 12 shows an amino acid sequence of pMistic (C3V).

SEQ ID NO: 13 shows a nucleic acid sequence of pMistic (C3L).

SEQ ID NO: 14 shows an amino acid sequence of pMistic (C3L).

SEQ ID NO: 15 shows a nucleic acid sequence of pMistic (C3I).

SEQ ID NO: 16 shows an amino acid sequence of pMistic (C3I).

SEQ ID NO: 17 shows a nucleic acid sequence of pMistic (C3S).

SEQ ID NO: 18 shows an amino acid sequence of pMistic (C3S).

SEQ ID NO: 19 shows a nucleic acid sequence of pMistic (C3V, T30C).

SEQ ID NO: 20 shows an amino acid sequence of pMistic (C3V, T30C).

SEQ ID NO: 21 shows a nucleic acid sequence of pMistic (C3V, S58C).

SEQ ID NO: 22 shows an amino acid sequence of pMistic (C3V, S58C).

SEQ ID NO: 23 shows a nucleic acid sequence of pMistic (C3V, N88C).

SEQ ID NO: 24 shows an amino acid sequence of pMistic (C3V, N88C).

SEQ ID NO: 25 shows a nucleic acid sequence of pMistic (C3V, E110C).

SEQ ID NO: 26 shows an amino acid sequence of pMistic (C3V, E110C).

SEQ ID NO: 27 shows a nucleic acid sequence of pMistic (EK), wherein "EK" denotes mutations of nucleotide residues 373-384 to encode Asp-Asp-Asp-Asp (instead of Glu-Glu-Gly-Glu) at positions 105-108 of the wild-type Mistic-L amino acid sequence.

SEQ ID NO: 28 shows an amino acid sequence of pMistic (EK).

SEQ ID NO: 29 shows a nucleic acid sequence of pMistic (EK, C3S).

SEQ ID NO: 30 shows an amino acid sequence of pMistic (EK, C3S).

SEQ ID NO: 31 shows a nucleic acid sequence of pMistic (EK, W13A).

SEQ ID NO: 32 shows an amino acid sequence of pMistic (EK, W13A).

SEQ ID NO: 33 shows a nucleic acid sequence of pMistic (EK, Q36E).

SEQ ID NO: 34 shows an amino acid sequence of pMistic (EK, Q36E).

SEQ ID NO: 35 shows a nucleic acid sequence of pMistic (EK, M75A).

SEQ ID NO: 36 shows an amino acid sequence of pMistic (EK, M75A).

SEQ ID NO: 37 shows a nucleic acid sequence encoding a peptide (or fusion protein domain) that includes a thrombin-cleavage site ("Thr").

SEQ ID NO: 38 shows an amino acid sequence of a peptide (or fusion protein domain) that includes a thrombin ("Thr") cleavage site.

SEQ ID NO: 39 shows a nucleic acid sequence of a linker ("Link").

SEQ ID NO: 40 shows an amino acid sequence of a linker ("Link").

SEQ ID NO: 41 shows a nucleic acid sequence of a linker ("L").

SEQ ID NO: 42 shows an amino acid sequence of a linker ("L").

SEQ ID NO: 43 shows a nucleic acid sequence of a linker ("Ll").

SEQ ID NO: 44 shows an amino acid sequence of a linker ("LI").

SEQ ID NO: 45 shows a nucleic acid sequence of a linker ("LINKER").

SEQ ID NO: 46 shows an amino acid sequence of a linker ("LINKER").

SEQ ID NO: 47 shows a nucleic acid sequence of a linker ("LINK").

SEQ ID NO: 48 shows an amino acid sequence of a linker ("LINK").

SEQ ID NO: 49 shows a nucleic acid sequence of a linker ("LINK2").

SEQ ID NO: 50 shows an amino acid sequence of a linker ("LINK2").

SEQ ID NO: 51 shows a nucleic acid sequence of pMistic-KchBsu265.

SEQ ID NO: 52 shows an amino acid sequence of pMistic-KchBsu265.

SEQ ID NO: 53 shows a nucleic acid sequence of pMistic (EK)-KchBsu265.

SEQ ID NO: 54 shows an amino acid sequence of pMistic (EK)-KchBsu265.

SEQ ID NO: 55 shows a nucleic acid sequence of pMistic (EK)-KchXfa297.

SEQ ID NO: 56 shows an amino acid sequence of pMistic (EK)-KchXfa297.

SEQ ID NO: 57 shows a nucleic acid sequence of pMistic (EK)-Link-KchMja209.

SEQ ID NO: 58 shows an amino acid sequence of pMistic (EK)-Link-KchMja209.

SEQ ID NO: 59 shows a nucleic acid sequence of pMistic (EK)-Link-KchPae283.

SEQ ID NO: 60 shows an amino acid sequence of pMistic (EK)-Link-KchPae283.

SEQ ID NO: 61 shows a nucleic acid sequence of pMistic-Link-KchPae283.

SEQ ID NO: 62 shows an amino acid sequence of pMistic-Link-KchPae283.

SEQ ID NO: 63 shows a nucleic acid sequence of pMistic-Thr-KchPae283.

SEQ ID NO: 64 shows an amino acid sequence of pMistic-Thr-KchPae283.

SEQ ID NO: 65 shows a nucleic acid sequence of pMistic (EK/C3S)-Link-KchPae283.

SEQ ID NO: 66 shows an amino acid sequence of pMistic (EK/C3S)-Link-KchPae283.

SEQ ID NO: 67 shows a nucleic acid sequence of pMistic (C3V)-Thr-KchPae283.

SEQ ID NO: 68 shows an amino acid sequence of pMistic (C3V)-Thr-KchPae283.

SEQ ID NO: 69 shows a nucleic acid sequence of pMistic (C3I)-Thr-KchPae283.

SEQ ID NO: 70 shows an amino acid sequence of pMistic (C3I)-Thr-KchPae283.

SEQ ID NO: 71 shows a nucleic acid sequence of pMistic (C3L)-Thr-KchPae283.

SEQ ID NO: 72 shows an amino acid sequence of pMistic (C3L)-Thr-KchPae283.

SEQ ID NO: 73 shows a nucleic acid sequence of pMistic (C3V/T30C)-Thr-KchPae283.

SEQ ID NO: 74 shows an amino acid sequence of pMistic (C3V/T30C)-Thr-KchPae283.

SEQ ID NO: 75 shows a nucleic acid sequence of pMistic (C3V/S58C)-Thr-KchPae283.

SEQ ID NO: 76 shows an amino acid sequence of pMistic (C3V/S58C)-Thr-KchPae283.

SEQ ID NO: 77 shows a nucleic acid sequence of pMistic (C3V/N88C)-Thr-KchPae283.

SEQ ID NO: 78 shows an amino acid sequence of pMistic (C3V/N88C)-Thr-KchPae283.

SEQ ID NO: 79 shows a nucleic acid sequence of pMistic (C3V/E110C)-Thr-KchPae283.

SEQ ID NO: 80 shows an amino acid sequence of pMistic (C3V/E110C)-Thr-KchPae283.

SEQ ID NO: 81 shows a nucleic acid sequence of pMistic (EK)-aKv1.1ΔT1.

SEQ ID NO: 82 shows an amino acid sequence of pMistic (EK)-aKv1.1ΔT1.

SEQ ID NO: 83 shows a nucleic acid sequence of pMistic (EK/W13A)-aKv1.1ΔT1.

SEQ ID NO: 84 shows an amino acid sequence of pMistic (EK/W13A)-aKv1.1ΔT1.

SEQ ID NO: 85 shows a nucleic acid sequence of pMistic (EK/Q36E)-aKv1.1ΔT1.

SEQ ID NO: 86 shows an amino acid sequence of pMistic (EK/Q36E)-aKv1.1ΔT1.

SEQ ID NO: 87 shows a nucleic acid sequence of pMistic (EK/M75A)-aKv1.1ΔT1.

SEQ ID NO: 88 shows an amino acid sequence of pMistic (EK/M75A)-aKv1.1ΔT1.

SEQ ID NO: 89 shows a nucleic acid sequence of pMistic (EK)-aKv1.1.

SEQ ID NO: 90 shows an amino acid sequence of pMistic (EK)-aKv1.1.

SEQ ID NO: 91 shows a nucleic acid sequence of pMistic (EK)-L-aKv1.1(Δ1-6).

SEQ ID NO: 92 shows an amino acid sequence of pMistic (EK)-L-aKv1.1(Δ1-6).

SEQ ID NO: 93 shows a nucleic acid sequence of pMistic (EK)-LI-aKv1.1(Δ1).

SEQ ID NO: 94 shows an amino acid sequence of pMistic (EK)-LI-aKv1.1(Δ1).

SEQ ID NO: 95 shows a nucleic acid sequence of pMistic (EK)-LINKER-aKv1.1.

SEQ ID NO: 96 shows an amino acid sequence of pMistic (EK)-LINKER-aKv1.1.

SEQ ID NO: 97 shows a nucleic acid sequence of pMistic (EK)-LINK-hKv1.5.

SEQ ID NO: 98 shows an amino acid sequence of pMistic (EK)-LINK-hKv1.5.

SEQ ID NO: 99 shows a nucleic acid sequence of pMistic (EK)-LINK-rKv2.1.

SEQ ID NO: 100 shows an amino acid sequence of pMistic (EK)-LINK-rKv2.1.

SEQ ID NO: 101 shows a nucleic acid sequence of pMistic (EK)-LINK-rKv3.1.

SEQ ID NO: 102 shows an amino acid sequence of pMistic (EK)-LINK-rKv3.1.

SEQ ID NO: 103 shows a nucleic acid sequence of pMistic (EK)-LINK-rKv1.2.

SEQ ID NO: 104 shows an amino acid sequence of pMistic (EK)-LINK-rKv1.2.

SEQ ID NO: 105 shows a nucleic acid sequence of pMistic (EK)-LINK2-rKv1.2.

SEQ ID NO: 106 shows an amino acid sequence of pMistic (EK)-LINK2-rKv1.2.

SEQ ID NO: 107 shows a nucleic acid sequence of pMistic (EK)-LINK-GABABR1.

SEQ ID NO: 108 shows an amino acid sequence of pMistic (EK)-LINK-GABABR1.

SEQ ID NO: 109 shows a nucleic acid sequence of pMistic (EK)-LINK-VIPR2.

SEQ ID NO: 110 shows an amino acid sequence of pMistic (EK)-LINK-VIPR2.

SEQ ID NO: 111 shows a nucleic acid sequence of pMis, which encodes an octa-histidine sequence (residues 1-60), a *B. subtilus* wild-type Mistic-L sequence (residues 61-390), and a linker sequence (residues 391-492).

SEQ ID NO: 112 shows an amino acid sequence of pMis.

SEQ ID NO: 113 shows a nucleic acid sequence of pMisT, which encodes an octa-histidine sequence (residues 1-60), a *B. subtilus* wild-type Mistic-L sequence (residues 61-390), an exogenous helix (residues 391-552), and a linker sequence (residues 553-654).

SEQ ID NO: 114 shows an amino acid sequence of pMisT.

SEQ ID NO: 115 shows a nucleic acid sequence of pMis-Alk2.

SEQ ID NO: 116 shows an amino acid sequence of pMis-Alk2.

SEQ ID NO: 117 shows a nucleic acid sequence of pMisT-Alk2.

SEQ ID NO: 118 shows an amino acid sequence of pMisT-Alk2.

SEQ ID NO: 119 shows a nucleic acid sequence of pMis-Alk3.

SEQ ID NO: 120 shows an amino acid sequence of pMis-Alk3.

SEQ ID NO: 121 shows a nucleic acid sequence of pMisT-Alk3.

SEQ ID NO: 122 shows an amino acid sequence of pMisT-Alk3.

SEQ ID NO: 123 shows a nucleic acid sequence of pMis-Alk5.

SEQ ID NO: 124 shows an amino acid sequence of pMis-Alk5.

SEQ ID NO: 125 shows a nucleic acid sequence of pMisT-Alk5.

SEQ ID NO: 126 shows an amino acid sequence of pMisT-Alk5.

SEQ ID NO: 127 shows a nucleic acid sequence of pMis-Alk6.

SEQ ID NO: 128 shows an amino acid sequence of pMis-Alk6.

SEQ ID NO: 129 shows a nucleic acid sequence of pMisT-Alk6.

SEQ ID NO: 130 shows an amino acid sequence of pMisT-Alk6.

SEQ ID NO: 131 shows a nucleic acid sequence of pMis-ActRII.

SEQ ID NO: 132 shows an amino acid sequence of pMis-ActRII.

SEQ ID NO: 133 shows a nucleic acid sequence of pMisT-ActRII.

SEQ ID NO: 134 shows an amino acid sequence of pMisT-ActRII.

SEQ ID NO: 135 shows a nucleic acid sequence of pMis-ActRIIb.

SEQ ID NO: 136 shows an amino acid sequence of pMis-ActRIIb.

SEQ ID NO: 137 shows a nucleic acid sequence of pMisT-ActRIIb.

SEQ ID NO: 138 shows an amino acid sequence of pMisT-ActRIIb.

SEQ ID NO: 139 shows a nucleic acid sequence of pMis-BMPRII.

SEQ ID NO: 140 shows an amino acid sequence of pMis-BMPRII.

SEQ ID NO: 141 shows a nucleic acid sequence of pMisT-BMPRII.

SEQ ID NO: 142 shows an amino acid sequence of pMisT-BMPRII.

SEQ ID NO: 143 shows a nucleic acid sequence of pMis-CRFR1.

SEQ ID NO: 144 shows an amino acid sequence of pMis-CRFR1.

SEQ ID NO: 145 shows a nucleic acid sequence of pMisT-CRFR1.

SEQ ID NO: 146 shows an amino acid sequence of pMisT-CRFR1.

SEQ ID NO: 147 shows a nucleic acid sequence of pMis-CRFR2β.

SEQ ID NO: 148 shows an amino acid sequence of pMis-CRFR2β.

SEQ ID NO: 149 shows a nucleic acid sequence of pMisT-CRFR2β.

SEQ ID NO: 150 shows an amino acid sequence of pMisT-CRFR2β.

SEQ ID NO: 151 shows a nucleic acid sequence of pMis-CD97.

SEQ ID NO: 152 shows an amino acid sequence of pMis-CD97.

SEQ ID NO: 153 shows a nucleic acid sequence of pMisT-CD97.

SEQ ID NO: 154 shows an amino acid sequence of pMisT-CD97.

SEQ ID NO: 155 shows a nucleic acid sequence of pMis-CCR5.

SEQ ID NO: 156 shows an amino acid sequence of pMis-CCR5.

SEQ ID NO: 157 shows a nucleic acid sequence of pMisT-CCR5.

SEQ ID NO: 158 shows an amino acid sequence of pMisT-CCR5.

SEQ ID NO: 159 shows a nucleic acid sequence of pMis-RAI3.

SEQ ID NO: 160 shows an amino acid sequence of pMis-RAI3.

SEQ ID NO: 161 shows a nucleic acid sequence of pMisT-RAI3.

SEQ ID NO: 162 shows an amino acid sequence of pMisT-RAI3.

SEQ ID NO: 163 shows a nucleic acid sequence of pMis-GPRC5B.

SEQ ID NO: 164 shows an amino acid sequence of pMis-GPRC5B.

SEQ ID NO: 165 shows a nucleic acid sequence of pMisT-GPRC5B.

SEQ ID NO: 166 shows an amino acid sequence of pMisT-GPRC5B.

SEQ ID NO: 167 shows a nucleic acid sequence of pMis-ETL.

SEQ ID NO: 168 shows an amino acid sequence of pMis-ETL.

SEQ ID NO: 169 shows a nucleic acid sequence of pMisT-ETL.

SEQ ID NO: 170 shows an amino acid sequence of pMisT-ETL.

SEQ ID NO: 171 shows a nucleic acid sequence of pMis-GABABR1.

SEQ ID NO: 172 shows an amino acid sequence of pMis-GABABR1.

SEQ ID NO: 173 shows a nucleic acid sequence of pMisT-GABABR1.

SEQ ID NO: 174 shows an amino acid sequence of pMisT-GABABR1.

SEQ ID NO: 175 shows a nucleic acid sequence of pMis-VIPR2.

SEQ ID NO: 176 shows an amino acid sequence of pMis-VIPR2.

SEQ ID NO: 177 shows a nucleic acid sequence of pMisT-VIPR2.

SEQ ID NO: 178 shows an amino acid sequence of pMisT-VIPR2.

SEQ ID NO: 179 shows a forward Mistic-L primer.

SEQ ID NO: 180 shows a reverse Mistic-L primer.

SEQ ID NOs: 181-183 show amino acid sequences of exemplar exogenous helices.

SEQ ID NOs: 184 and 185 show a nucleic acid and an amino acid sequence, respectively, of rKv4.2

SEQ ID NOs: 186 and 187 show the nucleic acid sequences of a representative pair of "MisticSeeker" primers for amplification from genomic DNA of nucleic acid sequences encoding Mistic polypeptides.

SEQ ID NOs: 188 and 189 show a nucleic acid and amino acid sequence, respectively, of M1.

SEQ ID NOs: 190 and 191 show a nucleic acid and amino acid sequence, respectively, of M2.

SEQ ID NOs: 192 and 193 show a nucleic acid and amino acid sequence, respectively, of M3.

SEQ ID NOs: 194 and 195 show a nucleic acid and amino acid sequence, respectively, of M4.

SEQ ID NOs: 196-201 show nucleic acid sequences encoding, and amino acid sequences of, fusion proteins comprising M1 and Alk3, BMPRII, or CRFR2β.

SEQ ID NOs: 202-207 show nucleic acid sequences encoding, and amino acid sequences of, fusion proteins comprising M2 and Alk3, BMPRII, or CRFR2β.

SEQ ID NOs: 208-213 show nucleic acid sequences encoding, and amino acid sequences of, fusion proteins comprising M3 and Alk3, BMPRII, or CRFR2β.

SEQ ID NOs: 218-219 show nucleic acid sequences encoding, and amino acid sequences of, fusion proteins comprising M4 and Alk3, BMPRII, or CRFR2β.

SEQ ID NOs: 220 and 221 show representative Mistic polypeptide consensus amino acid sequences.

DETAILED DESCRIPTION

I. Overview

Disclosed herein are isolated Mistic polypeptides, which include (or have) an amino acid sequence as set forth in SEQ ID NO: 2, 189, 191, 193, or 195, or which are capable of associating with a membrane and include (or have) at least 80% sequence identity to SEQ ID NO: 2, 189, 191, 193, or 195, or differ from SEQ ID NO: 2, 189, 191, 193, or 195 by one or more conservative amino acid substitutions (such as no more than about 50 highly conserved amino acid substitutions), or are functional fragments of SEQ ID NO: 2, 189, 191, 193, or 195. In specific embodiments, such polypeptide is no more than about 125 amino acids in length, and/or has no more than about 35% hydrophobic residues. In other embodiments, the isolated polypeptide has at least three (such as three or four) alpha helices, each from about 10 to about 25 amino acid residues in length and, in some embodiments, oriented anti-parallel to each other. In more particular embodiments, an alpha helix of the polypeptide is formed by about residue 8 to about residue 22, about residue 32 to about residue 55, about residue 67 to about residue 81, and about residue 89 to about residue 102 of the polypeptide. In still other embodiments, the isolated polypeptide has the tertiary structure characterized by the atomic structure coordinates set forth in PDB Accession No. 1YGM (release date Mar. 1, 2005) or in Table 4. Other isolated polypeptide embodiments, include an amino acid sequence as set forth in SEQ ID NO: 220 or 221, which, in some instances, are no more than about 125 amino acid residues in length and/or include at least three alpha helices (such as the alpha helices described above).

Also provided herein are recombinant fusion proteins including a cargo protein domain and a Mistic domain containing an amino acid sequence with at least 80% sequence identity to SEQ ID NO: 2, 189, 191, 193, or 195 (and, in particular examples, contain the amino acid sequence of SEQ ID NO: 2, 189, 191, 193, or 195). In other fusion protein examples, a Mistic domain includes an amino acid sequence as set forth SEQ ID NO: 220 or 221 and, in some case, such Mistic domain is no more than about 125 amino acid residues in length and/or forms at least three (in some cases, anti-parallel) alpha helices. In some examples, the cargo protein domain contains an integral membrane protein or a portion thereof (such as, a potassium channel protein, a G-protein coupled receptor protein, or a TGF-β family receptor protein). Specific fusion protein embodiments include (or have) the amino acid sequence set forth in SEQ ID NO: 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 197, 199, 201, 203, 205, 207, 209, 211, 213, 215, 217, or 219. In some cases, the Mistic domain of the fusion protein is located N-terminal of the cargo protein domain, C-terminal of the cargo domain, or within the cargo protein domain. In other instances, the fusion protein includes a linker between the cargo protein domain and the Mistic domain (such as, a linker from 1 to 100 amino acids), which linker may include (or have) an amino acid sequence as set forth in SEQ ID NO: 40, 42, 44, 46, 48, or 50). Other exemplar fusion proteins include a protease-recognition site between the cargo protein domain and the Mistic domain. In specific examples, the protease-recognition site is capable of being cleaved by thrombin, chymotrypsin, trypsin, plasmin, papain, pepsin, subtilisin, enterokinase or TEV protease, and/or is located in the linker. Still other fusion protein embodiments include a peptide tag, which, in some instances, may be located at the N-terminus of the Mistic domain, the C-terminus of the Mistic domain, the N-terminus of the cargo protein domain, or the C-terminus of the cargo protein domain. A peptide tag may include a FLAG tag, a His tag, a HA tag, a streptactin tag, or a biotinylation peptide (BioTag™). Some fusion proteins can include at least one exogenous helix domain (for example, located between the Mistic domain and the cargo protein domain). In particular examples, a disclosed fusion protein includes one or more of a peptide tag, a linker, and a protease-recognition site, each of which is located between the Mistic domain and the cargo protein domain.

This disclosure further contemplates isolated nucleic acid molecules encoding a disclosed Mistic polypeptide or fusion protein (such as any of those more particularly described in the immediately preceding paragraphs of this section). In some embodiments, an isolated nucleic acid molecule encodes a membrane-associated protein and includes (or has) a nucleic acid sequence having at least 80% sequence identity to SEQ ID NO: 1, 188, 190, 192, or 194. In other embodiments, an isolated nucleic acid molecule includes (or has) the nucleic acid sequence set forth in SEQ ID NO: 1, 3, 5, 7, 8, 9, 11, 13, 15, 17, 19, 21, 23, 25, 27, 29, 31, 33, 35, 188, 190, 192, or 194. In still other embodiments, an isolated nucleic acid molecule encodes a membrane-associated protein and hybridizes under high-stringency conditions with a nucleic acid probe comprising at least 30 contiguous nucleotides of SEQ ID NO: 1, 188, 190, 192, or 194. Some nucleic acid molecule embodiments, which encode Mistic fusion proteins, include (or have) a nucleic acid sequence as set forth in SEQ ID NO: 1, 3, 5, 7, 8, 9, 11, 13, 15, 17, 19, 21, 23, 25, 27, 29, 31, 33, 35, 51, 52, 53, 55, 57, 59, 61, 63, 65, 67, 69, 71, 73, 75, 77, 79, 81, 83, 85, 87, 89, 91, 93, 95, 97, 99, 101, 103, 105, 107, 109, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 196, 198, 200, 202, 204, 206, 208, 210, 212, 214, 216, or 218. The nucleic acid molecules contemplated by this disclosure also include a vector containing a promoter sequence operably linked to any of the disclosed nucleic acid molecules (such as those described with more particularity in the immediately preceding sentences of this paragraph). Cells transformed with such a vector are also contemplated. In some examples, the transformed cell is a prokaryotic cell (such as, a protease-deficient bacterial strain).

Methods of producing a recombinant fusion protein are also described herein. Some such methods involve expressing a recombinant fusion protein, which includes a cargo protein domain and a Mistic domain having at least 80% sequence identity to SEQ ID NO: 2, 189, 191, 193, or 195, in a cell (such as a prokaryotic cell), such that at least a portion of the fusion protein is incorporated into the cell membrane of the cell. In some instances, the cell is a prokaryotic cell (such as a bacterium). In more specific examples, the cell is a protease-deficient bacterium, such as any one of E. Coli strains B1-21, B1-21 (DE3), B1-21 (DE3) pLysS, Origami B, OmpT-defective CD41, CD43 (DE3), and phosphatidylenthanolamine (PE)-deficient AD93. In some method embodiments, the cargo protein domain of the expressed fusion protein is an integral membrane protein comprising at least one transmembrane domain. In more specific embodiments, at least one of the transmembrane domains is incorporated into the cell membrane and the integral membrane protein substantially retains its native conformation.

Other methods disclosed herein include methods of producing an isolated recombinant protein. Such methods involve (i) expressing a recombinant fusion protein, which includes a cargo protein domain and a Mistic domain having at least 80% sequence identity to SEQ ID NO: 2, 189, 191, 193, or 195, in a cell (such as a prokaryotic cell), such that at least a portion of the fusion protein is incorporated into the cell membrane of the cell, and (ii) isolating from the cell a cell membrane fraction containing the fusion protein. More specific method embodiments, further involve isolating the fusion protein from the cell membrane fraction. In particular examples, the fusion protein includes a protease-recognition site between the Mistic domain and the cargo protein domain. In some of these examples, the cargo protein domain is not substantially incorporated into the cell membrane and is tethered to the cell membrane by portion of the fusion protein that is incorporated into the cell membrane and, in even more particular examples, the protease-recognition site is cleaved to release the cargo protein domain. In some examples, a release cargo protein domain is isolated. Some methods of producing an isolated recombinant protein involve a cargo protein domain that includes an integral membrane protein (such as, in particular examples, a potassium channel, a G-protein coupled receptor, or a TGF-β family receptor).

Also described herein are methods of isolating a recombinant fusion protein or domain thereof, involving (i) expressing a recombinant fusion protein, which includes a cargo protein domain and a Mistic domain having at least 80% sequence identity to SEQ ID NO: 2, 189, 191, 193, or 195, in a cell (such as a prokaryotic cell), such that at least a portion of the fusion protein is incorporated into the cell membrane of the cell; (ii) isolating a cell membrane fraction from the cell; and (iii) isolating the fusion protein or the cargo protein domain from the cell membrane fraction. In some examples, a yield of isolated fusion protein or isolated cargo protein domain from the cell is no less than 0.1 mg/L of cells, or no less than 1 mg/L of cells.

Disclosed methods of expressing a recombinant protein also involve (i) transfecting a cell with an expression vector encoding a recombinant fusion protein, which includes a cargo protein domain and a Mistic domain having at least 80% sequence identity to SEQ ID NO: 2, 189, 191, 193, or 195; and (ii) expressing the fusion protein in the cell, such that the amount of the cargo protein domain expressed in the cell is greater than the amount expressed in a control cell transfected with a control expression vector encoding the cargo protein domain alone. In particular examples of these methods, the amount of cargo protein domain expressed in the cell is at least 50-fold greater than the amount of cargo protein domain expressed in the control cell.

Methods of stabilizing the expression of a recombinant protein are also disclosed. Such methods involve co-expressing the recombinant protein with a disclosed Mistic polypeptide. In some embodiments, stabilizing the expression of the recombinant protein involves increasing the solubility of the recombinant protein or preventing the aggregation of the recombinant protein. In other embodiments, the recombinant protein and Mistic polypeptide are coexpressed as a fusion protein.

II. Abbreviation and Terms

ER endoplasmic reticulum
GPCR G-protein coupled receptors
IM integral membrane
IPTG isopropyl-β-D-thiogalactopyranoside
Kv voltage-gated $K^+$ channel
LDAO lauryl-dimethylamine oxide
LMPG lyso-myristoyl-phosphotidyl-glycerol
Mistic Membrane Integrating Sequence for Translation of IM protein Constructs
MPB 3-(N-maleimido-propinyl) biocytin
MTSL (1-oxyl-2,2,5,5-tetramethyl-$\Delta^3$-pyrroline-3-methyl) methanethiosulfonate
NMR nuclear magnetic resonance spectroscopy
NOE nuclear Overhauser effect
ORF open-reading-frame
PDC protein-detergent complex
RMSD squared root of mean square deviations
RSO right-side-out [membrane]
TM Transmembrane Unless otherwise explained, all technical and scientific terms used herein have the same meaning as commonly understood by one of ordinary skill in the art to which the disclosed subject matter belongs. Definitions of common terms relating to biochemistry and antibodies may be found in Benjamin Lewin, *Genes V*, published by Oxford University Press, 1994 (ISBN 0-19-854287-9); Kendrew et al. (eds.), *The Encyclopedia of Molecular Biology*, published by Blackwell Science Ltd., 1994 (ISBN 0-632-02182-9); and Robert A. Meyers (ed.), *Molecular Biology and Biotechnology: a Comprehensive Desk Reference*, published by VCH Publishers, Inc., 1995 (ISBN-1-56081-569-8).

As used herein, the singular terms "a," "an," and "the" include plural referents unless context clearly indicates otherwise. Similarly, the word "or" is intended to include "and" unless the context clearly indicates otherwise. "Comprising" means "including." Hence "comprising A or B" means "including A or B" or "including A and B." All molecular weights, molecular mass values, or lengths given for nucleic acids or polypeptides are approximate, and are provided for description.

In order to facilitate review of the disclosed embodiments, the following explanations of specific terms are provided:

Alpha Helix: A particular helical folding of a polypeptide backbone in protein molecules, in which the carbonyl oxygens are hydrogen bonded to amide nitrogen atoms three residues along the chain. In a typical alpha helix, the translation of amino acid residues along the long axis of the helix is 0.15 nm and the rotation per residue is 100°; accordingly, there are 3.6 residues per turn. Side chains of helix-resident amino acids are arranged at the outside of the helix.

Associating [a Polypeptide] with a Membrane: The process of directing, targeting, or trafficking a polypeptide to a cell membrane or cell membrane-like structure so that the polypeptide is associated with the membrane or membrane-like structure. For example, a polypeptide is associated with a membrane or membrane-like structure if the polypeptide co-fractionates with the membrane or the membrane-like structure under conditions that maintain at least some of the structural integrity of the membrane or membrane-like structure (such as, in the absence of membrane-solubilizing agents). Methods of producing membrane fractions are commonly known in the art and exemplar methods are described herein. All or part of a polypeptide can be associated with a membrane or membrane-like structure by specific or non-specific interactions with the membrane or membrane-like structure, can be tethered to a membrane or membrane-like structure (either temporarily or permanently and with or without being incorporated to any degree into the membrane), and/or can be incorporated (in whole or in part) into the membrane or membrane-like structure. Exemplar membrane-like structures include, without limitation, micelles, liposomes, lipid rafts, or bicelles.

Cargo Protein: A polypeptide that is directed to a membrane as a result of an association with a disclosed Mistic polypeptide.

Encode: A polynucleotide is said to "encode" a polypeptide if, in its native state or when manipulated by methods well known to those of ordinary skill in the art, it can be transcribed and/or translated to produce the mRNA for and/or the polypeptide or a fragment thereof. The anti-sense strand is the complement of such a nucleic acid, and the encoding sequence can be deduced therefrom.

Fusion protein: A polypeptide formed by the joining of two or more heterologous polypeptides through a peptide bond formed by the amino terminus of one polypeptide and the carboxyl terminus of the other polypeptide. Each polypeptide joined into a fusion protein may be referred to as a "domain" or "element" of the fusion protein. With respect to each other, heterologous polypeptides joined into a fusion protein are referred to as "fusion partners."

G-protein Coupled Receptor Protein: A class of integral membrane proteins belonging to the "7TM" superfamily of transmembrane receptors, which is characterized by seven transmembrane helices. The extracellular portions of G-protein coupled receptors contain highly conserved cysteine residues which form disulfide bonds to stabilize the receptor structure. Unlike other types of IM protein receptors, whose ligand binding site is located in an extracellular domain, G-protein-coupled receptors ligands typically bind within the transmembrane domain. Upon ligand binding, G-protein coupled receptor proteins activate G proteins. Non-limiting examples of G-protein coupled receptors are listed in Table 3 and also include taste receptors, receptors of the olfactory epithelium, and receptors for acetylcholine, adenocorticotropin, rhodopsin, somatostatin, thyrotropin, vasopressin, VIP, GHRH, GABA and serotonin. Serotonin receptors are found in central and peripheral nervous systems, kidney, liver, pancreas, spleen, small intestine stomach, coronary and pulmonary arteries and aorta, heart and reproduction system.

Hybridization: Oligonucleotides and other nucleic acids hybridize by hydrogen bonding, which includes Watson-Crick, Hoogsteen or reversed Hoogsteen hydrogen bonding, between complementary bases. Generally, nucleic acid consists of nitrogenous bases that are either pyrimidines (cytosine (C), uracil (U), and thymine (T)) or purines (adenine (A) and guanine (G)). These nitrogenous bases form hydrogen bonds between a pyrimidine and a purine, and the bonding of the pyrimidine to the purine is referred to as base pairing. More specifically, A will hydrogen bond to T or U, and G will bond to C. Complementary refers to the base pairing that occurs between two distinct nucleic acid sequences or two distinct regions of the same nucleic acid sequence.

"Specifically hybridizable" and "specifically complementary" are terms that indicate a sufficient degree of complementarity such that stable and specific binding occurs between a first nucleic acid (such as, an oligonucleotide) and a DNA or RNA target. The first nucleic acid (such as, an oligonucleotide) need not be 100% complementary to its target sequence to be specifically hybridizable. A first nucleic acid (such as, an oligonucleotide) is specifically hybridizable when there is a sufficient degree of complementarity to avoid non-specific binding of the first nucleic acid (such as, an oligonucleotide) to non-target sequences under conditions where specific binding is desired. Such binding is referred to as specific hybridization.

Integral Membrane Protein: A protein that has at least one domain that is incorporated into a membrane (such as, a cell membrane). Typically, a membrane-associated domain of an IM protein is hydrophobic and/or is sufficiently embedded in the membrane so that the IM protein remains associated with the membrane during biochemical purification schemes that substantially preserve membrane integrity (e.g., that do not involve detergent(s) or other membrane-disrupting agents). In some cases, an IM protein membrane-associated domain spans the membrane and may be referred to as a "transmembrane" domain. Often (although not always), IM proteins also have one or more extra-membrane domains, such as an extra-cellular and/or cytoplasmic domain, which extend beyond the surface of the membrane. Exemplar integral membrane proteins are described herein and include, without limitation, G-protein coupled receptor proteins, TGF-β family receptor proteins, and $K^+$ channel proteins.

Isolated: An "isolated" biological component (such as a polynucleotide, polypeptide, or cell) has been purified away from other biological components in a mixed sample (such as a cell or nuclear extract). For example, an "isolated" polypeptide or polynucleotide is a polypeptide or polynucleotide that has been separated from the other components of a cell in which the polypeptide or polynucleotide was present (such as an expression host cell for a recombinant polypeptide or polynucleotide).

The term "purified" refers to the removal of one or more extraneous components from a sample. For example, where recombinant polypeptides are expressed in host cells, the polypeptides are purified by, for example, the removal of host cell proteins thereby increasing the percent of recombinant polypeptides in the sample. Similarly, where a recombinant polynucleotide is present in host cells, the polynucleotide is purified by, for example, the removal of host cell polynucleotides thereby increasing the percent of recombinant polynucleotide in the sample. Isolated polypeptides or nucleic acid molecules, typically, comprise at least 50%, at least 60%, at least 70%, at least 80%, at least 90%, at least 95% or even over 99% (w/w or w/v) of a sample.

Polypeptides and nucleic acid molecules are isolated by methods commonly known in the art and as described herein. Purity of polypeptides or nucleic acid molecules may be determined by a number of well-known methods, such as polyacrylamide gel electrophoresis for polypeptides, or agarose gel electrophoresis for nucleic acid molecules.

Linker: A relatively short series of amino acids that separates elements or domains of a fusion protein.

Membrane: A synthetic or naturally occurring, organized structure of lipids or other amphipathic molecules. Typically, naturally occurring membranes are relatively thin and structured bilayers of lipids (such as, phospholipids) that encapsulate cells and intracellular organelles. The term "cell membrane" specifically refers to a membrane encapsulating a cell. As used herein, the term "membrane" also contemplates membrane-like structures, such as micelles, bicelles, lipid rafts, or liposomes, which are comprised of amphipathic molecules and have a hydrophobic core and a hydrophilic surface. Unless the context requires otherwise, the term "membrane" encompasses membrane-like structures. Membrane-like structures are capable of incorporating an integral membrane protein in substantially the same conformation as such IM protein has in a lipid bilayer membrane, such as a cell membrane.

Ortholog: A gene from one species, for example *Bacillus subtilus*, that has a common origin and substantially similar function as a gene from another species, for example, *E. coli, Drosophila*, or yeast.

Peptide tag: A typically short amino acid sequence (for example, from 1 to 30 amino acids, such as from 4 to 20, or from 4 to 15 amino acid residues) that permits the tagged protein to be readily detected or purified, for example, by affinity purification.

Primer: An oligonucleotide, whether occurring naturally as in a purified restriction digest or produced synthetically, which is capable of acting as a point of initiation of synthesis when placed under conditions in which synthesis of a primer extension product which is complementary to a nucleic acid strand is induced, (i.e., in the presence of nucleotides and of an inducing agent such as DNA polymerase and at a suitable temperature and pH). The primer is preferably single stranded for maximum efficiency in amplification, but may alternatively be double stranded. If double stranded, the primer is first treated to separate its strands before being used to prepare extension products. In some examples, the primer is an oligodeoxyribonucleotide. A primer is of sufficient length to prime the synthesis of extension products in the presence of the inducing agent. The exact lengths of the primers will depend on many factors, including temperature, source of primer and the use of the method. A primer can be at least 15, at least 20, at least 23, at least 25, at least 30, at least 35, at least 40, at least 45, at least 50, at least 100, at least 150, at least 200, at least 250 or at least 300 consecutive nucleotides of a particular nucleotide sequence (such as a Mistic polypeptide-encoding nucleic acid sequence, including SEQ ID NO: 1, 188, 190, 192, or 194).

Methods for preparing and using primers are described, for example, in Sambrook et al. (In *Molecular Cloning: A Laboratory Manual*, Cold Spring Harbor Laboratory Press, New York, 1989), Ausubel et al. (In *Current Protocols in Molecular Biology*, Greene Publ. Assoc. and Wiley-Intersciences, 1998), and Innis et al. (*PCR Protocols, A Guide to Methods and Applications*, Academic Press, Inc., San Diego, Calif., 1990). PCR primer pairs can be derived from a known sequence, for example, by using computer programs intended for that purpose such as Primer (Version 0.5, © 1991, Whitehead Institute for Biomedical Research, Cambridge, Mass.).

Probe: A detectable nucleic acid molecule that specifically hybridizes to another nucleic acid molecule. Probes are useful, for example, to detect, identify or isolated nucleic acid molecules to which the probe binds. A probe can be at least 15, at least 20, at least 23, at least 25, at least 30, at least 35, at least 40, at least 45, at least 50, at least 100, at least 150, at least 200, at least 250 or at least 300 consecutive nucleotides of a particular nucleotide sequence (such as a Mistic polypeptide-encoding nucleic acid sequence, including SEQ ID NO: 1, 188, 190, 192, or 194). Methods for preparing and using probes are described, for example, in Sambrook et al. (In *Molecular Cloning: A Laboratory Manual*, Cold Spring Harbor Laboratory Press, New York, 1989), Ausubel et al. (In *Current Protocols in Molecular Biology*, Greene Publ. Assoc. and Wiley-Intersciences, 1998), and Innis et al. (*PCR Protocols, A Guide to Methods and Applications*, Academic Press, Inc., San Diego, Calif., 1990).

A probe may be single stranded or double stranded. In some instances, a probe is directly attached to a detectable label or reporter molecule. Typical labels include radioactive isotopes, enzyme substrates, co-factors, ligands, chemiluminescent or fluorescent agents, haptens, and enzymes. Methods for labeling and guidance in the choice of labels appropriate for various purposes are discussed, e.g., in Sambrook et al. (In: *Molecular Cloning: A Laboratory Manual*, Cold Spring Harbor Laboratory Press, New York, 1989) and Ausubel et al. (In: *Current Protocols in Molecular Biology*, Greene Publ. Assoc. and Wiley-Intersciences, 1992).

Protease-deficient [Bacterial Strain]: A bacterial strain (whether naturally occurring or genetically engineered) that fails to express one or more proteases expressed by a corresponding wild-type bacterium. Non-limiting exemplar protease-deficient bacterial strains are degP-deficient *E. coli*, ompT-deficient *E. coli*, and BL21 *E. coli* (and related strains). Representative protease-deficient bacterial strains are also described in U.S. Pat. Nos. 5,143,846; 5,508,192; 5,264,366; and 5,264,365; Intl. Pub. No. WO 88/05821; and Chaudhury and Smith, *J. Bacteriol.*, 160:788-791, 1984; Elish, et al., *J. Gen. Microbiol.*, 134:1355-1364, 1988; Baneyx and Georgiou, In: *Stability of Protein Pharmaceuticals: Chemical and Physical Pathways of Protein Degradation*, T. Akers and C. Manning (Eds), 1992; McIntosh, et al., *J. Bacteriol.*, 137: 653-657, 1979; Baneyx and Georgiou, *Enzyme Microb. Technol.*, 11:559-567, 1989; Baneyx and Georgiou, *J. Bacteriol.*, 172:491-494, 1990. Protease-deficient bacterial strains are commercially available from various suppliers, including without limitation American Type Culture Collection (e.g., ATCC Nos. 55039, 55040, 55099, and 55100), Novagen (e.g., Strain BL21(DE3), B21(DE3)-pLys, Origami (and related strains), Rosetta (and related strains)), Stratagene (e.g., BL21 CodonPlus™), Invitrogen (e.g., BL21-S1, BL21-AI), or Amersham (e.g., BL21).

Potassium Channel: A common type of ion channel found in eukaryotes and prokaryotes, which forms a membrane-spanning, potassium-selective pore. Potassium channels are found in most cells and perform a variety of functions, including control of cell membrane electrical excitability and regulation of cellular processes (such as, the secretion of hormones). Potassium channels open or close in response to the transmembrane voltage, or the presence of calcium ions or other signaling molecules. Over 80 mammalian genes are known to encode potassium channel subunits. Potassium channels have a tetrameric arrangement with four subunits arranged around a central pore. Potassium channel subunits have a distinctive pore-loop structure that lines the top of the pore and is responsible for potassium selectivity. Exemplar potassium channel proteins are listed in Table 3.

Recombinant: The term "recombinant" refers to polypeptides or polynucleotides produced by molecular engineering. In most instances, a molecularly engineered polypeptide or polynucleotide has a sequence that is not naturally occurring. Molecular engineering can involve chemical synthesis of polypeptides or polynucleotides from corresponding peptides (or amino acids) or oligonucleotides (or nucleotides), respectively. Alternatively and more commonly, molecular engineering involves the manipulation of nucleic acid sequences using a myriad of now-common techniques, such as PCR, restriction digesting, ligation, DNA mutagenesis, and others. For example, a recombinant polynucleotide may be produced by combining (e.g., by ligation) two or more otherwise unrelated nucleic acid sequences to form a recombinant polynucleotide, for instance, which encodes a fusion protein. In another example, one or more nucleotides of a polynucleotide may be mutated (e.g., by site-directed mutagenesis) to form a recombinant polynucleotide, for instance, which encodes a recombinant mutant protein. In yet another example, a portion of a polynucleotide can be deleted (e.g., by PCR, or restriction enzyme digestion followed by re-ligation) to form a recombinant polynucleotide, for instance, which encodes another recombinant mutant protein. A recombinant nucleic acid sequence encodes a corresponding "recombinant" polypeptide. One of ordinary skill in the art will appreciate that many different recombinant polynucleotides and recombinant polypeptides may be created by molecular engineering.

Sequence identity: The similarity between two nucleic acid sequences or between two amino acid sequences is expressed in terms of the level of sequence identity shared between the sequences. Sequence identity is typically expressed in terms of percentage identity; the higher the percentage, the more similar the two sequences.

Methods for aligning sequences for comparison are well known in the art. Various programs and alignment algorithms are described in: Smith and Waterman, *Adv. Appl. Math.* 2:482, 1981; Needleman and Wunsch, *J. Mol. Biol.* 48:443, 1970; Pearson and Lipman, *Proc. Natl. Acad. Sci. USA* 85:2444, 1988; Higgins and Sharp, *Gene* 73:237-244, 1988; Higgins and Sharp, *CABIOS* 5:151-153, 1989; Corpet et al., *Nucleic Acids Research* 16:10881-10890, 1988; Huang, et al., *Computer Applications in the Biosciences* 8:155-165, 1992; Pearson et al., *Methods in Molecular Biology* 24:307-331, 1994; Tatiana et al., (1999), *FEMS Microbiol. Lett.*, 174:247-250, 1999. Altschul et al. present a detailed consideration of sequence-alignment methods and homology calculations (*J. Mol. Biol.* 215:403-410, 1990).

The National Center for Biotechnology Information (NCBI) Basic Local Alignment Search Tool (BLAST™, Altschul et al. *J. Mol. Biol.* 215:403-410, 1990) is available from several sources, including the National Center for Biotechnology Information (NCBI, Bethesda, Md.) and on the Internet, for use in connection with the sequence-analysis programs blastp, blastn, blastx, tblastn and tblastx. A description of how to determine sequence identity using this program is available on the internet under the help section for BLAST™.

For comparisons of amino acid sequences of greater than about 30 amino acids, the "Blast 2 sequences" function of the BLAST™ (Blastp) program is employed using the default BLOSUM62 matrix set to default parameters (cost to open a gap [default=5]; cost to extend a gap [default=2]; penalty for a mismatch [default=−3]; reward for a match [default=1]; expectation value (E) [default=10.0]; word size [default=3]; number of one-line descriptions (V) [default=100]; number of alignments to show (B) [default=100]). When aligning short peptides (fewer than around 30 amino acids), the alignment should be performed using the Blast 2 sequences function, employing the PAM30 matrix set to default parameters (open gap 9, extension gap 1 penalties). Proteins with even greater similarity to the reference sequences will show increasing percentage identities when assessed by this method, such as at least 50%, at least 60%, at least 70%, at least 80%, at least 85%, at least 90%, or at least 95% sequence identity.

For comparisons of nucleic acid sequences, the "Blast 2 sequences" function of the BLAST™ (Blastn) program is employed using the default BLOSUM62 matrix set to default parameters (cost to open a gap [default=11]; cost to extend a gap [default=1]; expectation value (E) [default=10.0]; word size [default=11]; number of one-line descriptions (V) [default=100]; number of alignments to show (B) [default=100]). Nucleic acid sequences with even greater similarity to the reference sequences will show increasing percentage identities when assessed by this method, such as at least 60%, at least 70%, at least 75%, at least 80%, at least 85%, at least 90%, at least 95%, or at least 98% sequence identity.

TGF-β Family Receptor Protein: A receptor for the TGF-β superfamily of ligands. Members of the TGF-β family receptor proteins include, but are not limited to, Alk2 (Activin type Ia receptor); Alk3 (BMP type 1a receptor, also referred to as ALK3); Alk5 (TGB-beta type I receptor); Alk6 (BMP type Ib receptor); ActRII (Activin type II receptor); ActRIIb (Activin type IIb receptor); BMPRII (BMP type II receptor); TGFBR2 (TGF-beta receptor type II precursor); ALK1 (Serine/threonine-protein kinase receptor R3 precursor); ALK4 (Serine/threonine-protein kinase receptor R2); and ALK7 (Activin receptor-like kinase 7).

Vector: A nucleic acid molecule capable of transporting a non-vector nucleic acid sequence which has been introduced into the vector. One type of vector is a "plasmid," which refers to a circular double-stranded DNA into which non-plasmid DNA segments may be ligated. Other vectors include cosmids, bacterial artificial chromosomes (BAC) and yeast artificial chromosomes (YAC). Another type of vector is a viral vector, wherein additional DNA segments may be ligated into all or part of the viral genome. Viral vectors that infect bacterial cells are referred to as bacteriophages. Certain vectors are capable of autonomous replication in a host cell into which they are introduced (for example, vectors having a bacterial origin of replication replicate in bacteria hosts). Other vectors can be integrated into the genome of a host cell upon introduction into the host cell and are replicated along with the host genome. Some vectors contain expression control sequences (such as, promoters) and are capable of directing the transcription of an expressible nucleic acid sequence that has been introduced into the vector. Such vectors are referred to as "expression vectors." A vector can also include one or more selectable marker genes and/or genetic elements known in the art.

Except as otherwise noted, methods and techniques for practice of the disclosed subject matter are generally performed according to conventional methods well known in the art and as described in various general and more specific references that are cited and discussed throughout the specification. See, e.g., Sambrook et al., *Molecular Cloning: A Laboratory Manual,* 2d ed., Cold Spring Harbor Laboratory Press, 1989; Sambrook et al., *Molecular Cloning: A Labora-* tory Manual, 3d ed., Cold Spring Harbor Press, 2001; Ausubel et al., Current Protocols in Molecular Biology, Greene Publishing Associates, 1992 (and Supplements to 2000); Ausubel et al., Short Protocols in Molecular Biology: A Compendium of Methods from Current Protocols in Molecular Biology, 4th ed., Wiley & Sons, 1999; Harlow and Lane, Antibodies: A Laboratory Manual, Cold Spring Harbor Laboratory Press, 1990; and Harlow and Lane, Using Antibodies: A Laboratory Manual, Cold Spring Harbor Laboratory Press, 1999. In addition, suitable methods and materials are described throughout the specification. The materials, methods, and examples are illustrative only and not intended to be limiting.

All publications, patent applications, patents, and other references mentioned herein are incorporated by reference in their entirety to the extent permitted by applicable law.

III. Mistic Nucleic Acid Molecules

This disclosure provides nucleic acid sequences encoding membrane-associating proteins, referred to as Mistic (for Membrane Integrating Sequence for Translation of IM protein Constructs) polypeptides and variants thereof. Representative Mistic polypeptide-encoding nucleic acid molecules (also referred to as Mistic nucleic acid molecules or Mistic nucleic acid sequences) and their corresponding amino acid sequence are shown in SEQ ID NOs: 1 and 2, SEQ ID NOs: 188 and 189, SEQ ID NOs: 190 and 191, SEQ ID NOs: 192 and 193, and SEQ ID NOs: 194 and 195, respectively.

With the provision herein of Mistic nucleic acid sequences, any method known to those of skill in the art may be used to isolate or produce such prototypic nucleic acid sequences and variants thereof. For example, in vitro nucleic acid amplification (such as polymerase chain reaction (PCR)) may be utilized as a simple method for producing Mistic nucleic acid sequences. PCR is a standard technique, which is described, for instance, in PCR Protocols: A Guide to Methods and Applications (Innis et al., San Diego, Calif.: Academic Press, 1990), or PCR Protocols, Second Edition (Methods in Molecular Biology, Vol. 22, ed. by Bartlett and Stirling, Humana Press, 2003).

A representative technique for producing a Mistic nucleic acid molecule by PCR involves preparing a sample containing a target nucleic acid molecule that encodes a Mistic polypeptide sequence (such as Mistic-L, M1, M2, M3, or M4). For example, DNA or RNA (such as mRNA or total RNA) may serve as a suitable target nucleic acid molecule for PCR reactions. Optionally, the target nucleic acid molecule is extracted from cells by any one of a variety of methods well known to those of ordinary skill in the art. Sambrook et al. (In Molecular Cloning: A Laboratory Manual, Cold Spring Harbor Laboratory Press, New York, 1989) and Ausubel et al. (In Current Protocols in Molecular Biology, Greene Publ. Assoc. and Wiley-Intersciences, 1992) provide descriptions of methods for DNA and RNA isolation. Target nucleic acid molecules encoding Mistic-L and M1 are found, at least, in Bacillus subtilis. Thus, in some examples, RNA or DNA may be extracted from B. subtilis cells. Target nucleic acid molecules encoding M2, M3, and M4 are found, at least, in B. licheniformis, B. mojavensis, and B. atrophaeus, respectively; thus, these bacteria may also serve as sources of RNA or DNA for preparing Mistic nucleic acid sequences. In examples where RNA is the initial target, the RNA is reverse transcribed (using one of a myriad of reverse transcriptases commonly known in the art) to produce a double-stranded template molecule for subsequent amplification. This particular method is known as reverse transcriptase (RT)-PCR. Representative methods and conditions for RT-PCR are described, for example, in Kawasaki et al. (In PCR Protocols, A Guide to Methods and Applications, Innis et al. (eds.), 21-27, Academic Press, Inc., San Diego, Calif., 1990).

The selection of amplification primers will be made according to the portion(s) of the target nucleic acid molecule that is to be amplified. In various embodiments, primers may be chosen to amplify all or part of a Mistic polypeptide-encoding sequence. Variations in amplification conditions may be required to accommodate primers and amplicons of differing lengths and composition; such considerations are well known in the art and are discussed for instance in Innis et al. (PCR Protocols, A Guide to Methods and Applications, San Diego, Calif.: Academic Press, 1990). By way of example, the portion of the B. subtilis genome encoding Mistic-L (approximately 333 base pairs) may be amplified using the following combination of primers:

```
(forward)
                                    (SEQ ID NO: 179)
5'-TCAGGGCCATGGCATGTTTTGTACATTTTTTG-3'

(reverse)
                                    (SEQ ID NO: 180)
5'-TCAGGAATTCAGCTTGATTCCGTT-3'
```

These primers are illustrative only; one skilled in the art will appreciate that many different primers may be derived from the provided Mistic nucleic sequence in order to amplify all or part of other Mistic polypeptide-encoding sequence (such as nucleic acid sequences encoding M1, M2, M3, or M4).

PCR primers will comprise at least 10 consecutive nucleotides of a Mistic nucleic acid sequence (e.g., a nucleic acid sequence encoding Mistic-L, M1, M2, M3 or M4). One of skill in the art will appreciate that sequence differences between a prototypical Mistic nucleic acid sequence and the target nucleic acid to be amplified may result in lower amplification efficiencies. To compensate for this, longer PCR primers or lower annealing temperatures may be used during the amplification cycle. Whenever lower annealing temperatures are used, sequential rounds of amplification using nested primer pairs may be used to enhance specificity.

Nucleotide variants of Mistic nucleic acid sequences are comprehended by this disclosure. Such nucleotide variants may be naturally occurring (such as orthologs from other organism) or produced using commonly known techniques, including without limitation site-directed mutagenesis or PCR. Standard techniques for DNA mutagenesis are provided, for instance, in Sambrook et al. (Molecular Cloning: A Laboratory Manual, New York: Cold Spring Harbor Laboratory Press, 1989, Ch. 15). In addition, numerous commercially available kits are available to perform DNA mutagenesis (see, for example, Quikchange™ Site-Directed Mutagenesis Kit (Stratagene), GeneTailor™ Site-Directed Mutagenesis System (Invitrogen); GPS™-M Mutagenesis System (New England Biolabs, Diversify™ PCR Random Mutagenesis Kit (BD Biosciences Clontech); Mutation Generation System (MJ Research); Exsite™ PCR-Based Site-Directed Mutagenesis Kit (Stratagene); GeneMorph™ PCR Mutagenesis Kit (Stratagene); or LA PCR Mutagenesis Kit (Takara Mirus Bio)).

Variant Mistic nucleic acid sequences differ from a disclosed sequence by deletion, addition, or substitution of nucleotides, and encode a protein that retains at least one Mistic polypeptide function. Functions of a prototypic Mistic polypeptide include, without limitation, the ability to associate (for example, autonomously associate) with a membrane (such as, a bacterial cell membrane) or membrane-like structure (such as, a micelle or liposome), and/or to traffic a fusion partner (such as, an IM protein) to a cell membrane and/or to stabilize the structure of a fusion partner (for example, to prevent aggregation and/or facilitate solubilization of a detergent-solubilized IM fusion partner). In some embodiments, Mistic nucleic acid variants share at least 70%, at least 75%, at least 80%, at least 85%, at least 90%, at least 95%, or at least 98% nucleotide sequence identity with a disclosed Mistic nucleic acid sequence, such as SEQ ID NO: 1, 188, 190, 192 or 194. Alternatively, related nucleic acid molecules can have no more than 3, 5, 10, 20, 50, 75, or 100 nucleic acid changes compared to SEQ ID NO: 1, 188, 190, 192 or 194.

In one embodiment, Mistic nucleic acid sequence variants may differ from the disclosed sequences by alteration of the coding region to fit the codon usage bias of a particular organism, for example, an organism into which the nucleic acid molecule is to be introduced. In other embodiments, Mistic nucleic acid sequence variants are derived by taking advantage of the degeneracy of the genetic code to alter the Mistic coding sequence. In these embodiments, the variant nucleotide sequence may be substantially different from a prototypic Mistic nucleic acid sequence (e.g., SEQ ID NO: 1, 188, 190, 192 or 194) and, nevertheless, encode a protein having an amino acid sequence substantially similar to a disclosed Mistic polypeptide (e.g., Mistic-L, M1, M2, M3, or M4). For example, because of redundancy in the genetic code, any one of four nucleotide codons encode alanine (i.e., GCT, GCG, GCC or GCA); accordingly, the sequence encoding any alanine residue within a Mistic polypeptide could be changed to any of these alternative codons without affecting the amino acid composition or characteristics of the encoded protein. Analogous redundancies are well known for each amino acid. The genetic codes for a variety of organisms are publicly available on the National Center for Biotechnology Information (NCBI) Taxonomy website. In the vertebrate ("standard") and bacterial genetic codes, methionine and tryptophan are the only two amino acids encoded by just one codon (ATG and TGG, respectively) (see also, Osawa et al., *Microbiol Rev.*, 56:229-264, 1992; Jukes and Osawa, *Comp. Biochem. Physiol.*, 106B:489-494, 1993).

An alternative indication that two nucleic acid molecules are closely related is that the two molecules hybridize to each other. In certain embodiments, Mistic nucleic acid sequence variants hybridize to a disclosed Mistic nucleic acid sequences or fragments thereof (such as SEQ ID NO: 1, 188, 190, 192 or 194, or fragments thereof), for example, under low stringency, high stringency, or very high stringency conditions. Hybridization conditions resulting in particular degrees of stringency will vary depending upon the nature of the hybridization method of choice and the composition and length of the hybridizing nucleic acid sequences. Generally, the temperature of hybridization and the ionic strength (especially the Na$^+$ concentration) of the hybridization buffer will determine the stringency of hybridization, although wash times also influence stringency. Calculations regarding hybridization conditions required for attaining particular degrees of stringency are discussed by Sambrook et al. (ed.), *Molecular Cloning: A Laboratory Manual*, 2nd ed., vol. 1-3, Cold Spring Harbor Laboratory Press, Cold Spring Harbor, N.Y., 1989, chapters 9 and 11.

The following are representative hybridization conditions and are not meant to be limiting.

Very High Stringency (Detects Sequences that Share about 90% Sequence Identity)

| | |
|---|---|
| Hybridization: | 5x SSC at 65° C. for 16 hours |
| Wash twice: | 2x SSC at room temperature (RT) for 15 minutes each |
| Wash twice: | 0.5x SSC at 65° C. for 20 minutes each |

High Stringency (Detects Sequences that Share about 80% Sequence Identity or Greater)

| | |
|---|---|
| Hybridization: | 5x-6x SSC at 65° C.-70° C. for 16-20 hours |
| Wash twice: | 2x SSC at RT for 5-20 minutes each |
| Wash twice: | 1x SSC at 55° C.-70° C. for 30 minutes each |

Low Stringency (Detects Sequences that Share Greater than about 50% Sequence Identity)

| | |
|---|---|
| Hybridization: | 6x SSC at RT to 55° C. for 16-20 hours |
| Wash at least twice: | 2x-3x SSC at RT to 55° C. for 20-30 minutes each. |

In some embodiments, a Mistic nucleic acid sequence variant is an ortholog of a disclosed Mistic polypeptide-encoding sequence. With the provision of the disclosed prototypic Mistic nucleic acid sequences, the cloning by standard methods of nucleic acid molecules (such as, genes, cDNAs, or other ORFs) that encode Mistic orthologs in other organisms (such as, other *Bacillus species*, *B. subtilis* subspecies or strains, *B. mojavensis* subspecies or strains, *B. atrophaeus* subspecies or strains, *B. licheniformis* subspecies or strains, or other genera of bacteria) is now enabled. As with other Mistic variants, Mistic orthologs of the disclosed Mistic nucleic acid molecules encode a polypeptide capable of associating with a membrane and/or trafficking a fusion partner to a membrane (and/or performing another Mistic polypeptide function), and will generally share at least 70% sequence identity with a disclosed Mistic nucleic acid sequence (for example, SEQ ID NO: 1, 188, 190, 192 or 194). Sequence identity will generally be greater in organisms more closely related to *B. subtilis, B. mojavensis, B. atrophaeus*, or *B. licheniformis* including, for example, other subspecies or strains of such *Bacillus* sp., other *Bacillus* species, and other genera of bacteria. In specific embodiments, orthologous Mistic molecules may share at least 60%, at least 70%, at least 75%, at least 80% at least 85%, at least 90%, at least 93%, at least 95%, or at least 98% nucleic acid sequence identity with a disclosed Mistic nucleotide or amino acid sequences.

Any method known in the art may be used to isolate Mistic orthologs. For example, both conventional hybridization and PCR amplification procedures may be utilized to clone Mistic orthologs. Direct PCR amplification may be performed on cDNA or genomic libraries prepared from an organism having a Mistic ortholog (such as, other *B. subtilis* subspecies or strains), or RT-PCR may be performed using RNA extracted from such organism using standard methods. Exemplary methods for isolating Mistic orthologs are provided in Example 10.

For conventional hybridization techniques, a labeled probe derived from a Mistic nucleic acid sequence (such as SEQ ID NO: 1, 188, 190, 192 or 194) may be hybridized to a cDNA or genomic library prepared from an organism having a Mistic ortholog (such as, subspecies or strains of *B. subtilis, B. mojavensis, B. atrophaeus,* or *B. licheniformis,* other *Bacillus* sp. or other genera of bacteria). The hybridization probe is preferably conjugated with a detectable label such as a radioactive label. A hybridization signal may be detected using methods known in the art. The hybridizing colony or plaque (depending on the type of library used) is purified and the cloned sequence contained in that colony or plaque isolated and characterized.

Mistic orthologs may also be obtained by immunoscreening of an expression library. Antibodies (monoclonal or polyclonal) that are useful for performing such immunoscreening can be prepared using a Mistic polypeptide amino acid sequence provided herein. Methods for expressing and isolating such Mistic polypeptides are commonly known and specific exemplary methods are provided herein. Antibodies also may be raised against synthetic peptides derived from a Mistic amino acid sequence presented herein. Methods of raising antibodies are well known in the art and are described generally in Harlow and Lane, *Antibodies, A Laboratory Manual*, Cold Springs Harbor, 1988.

Fragments of a disclosed Mistic nucleic acid sequence (e.g., SEQ ID NO: 1, 188, 190, 192 or 194) are encompassed by the present disclosure. Such nucleic acid fragments include, for instance, oligonucleotides (which are useful as, e.g., probes and/or primer) and nucleic acid sequences encoding functional fragments of a Mistic polypeptide. A functional Mistic polypeptide fragment is a portion of a disclosed Mistic polypeptide sequence that retains at least one functional activity of the full-length Mistic polypeptide from which the fragment is obtained (e.g., membrane-associating activity and/or fusion-partner-stabilizing activity). The functional properties of Mistic polypeptides are discussed in detail elsewhere in this disclosure.

In one embodiment, Mistic nucleic acid fragments (such as, oligonucleotides) may comprise a sequence of at least 10 consecutive nucleotides of a Mistic nucleic acid sequence. One of skill in the art will appreciate that Mistic-derived nucleic acid fragments (such as, oligonucleotides) of various lengths are useful for a variety purposes. For example, the specificity of an oligonucleotide probe or primer increases with its length. Thus, in some embodiments, an oligonucleotide (such as, a probe or primer) may comprise at least 15, at least 20, at least 23, at least 25, at least 30, at least 35, at least 40, at least 45, at least 50 or more consecutive nucleotides of Mistic nucleotide sequences. In other examples, Mistic nucleic acid fragments (such as, oligonucleotides, probes, or primers) can be at least 100, at least 150, at least 200, at least 250 or at least 300 consecutive nucleic acids of a disclosed Mistic sequence (e.g., SEQ ID NO: 1, 188, 190, 192 or 194).

Mistic nucleic acid fragments (such as an oligonucleotide or a nucleic acid sequence encoding a functional Mistic polypeptide fragment) may be obtained from any region of a disclosed Mistic nucleic acid sequence. By way of example, a Mistic nucleic acid sequence (such as, SEQ ID NO: 1, 188, 190, 192 or 194) may be apportioned into about halves, thirds or quarters based on sequence length, and the isolated nucleic acid molecules (e.g., oligonucleotides or a nucleic acid sequence encoding a functional Mistic polypeptide fragment) may be derived from the first or second halves of the molecules, from any of the three thirds, or from any of the four quarters. A Mistic nucleic acid sequence also could be divided into smaller regions, e.g. about eighths, sixteenths, twentieths, fiftieths and so forth, with similar effect. One of ordinary skill in the art can readily ascertain from the provided sequences which nucleotide numbers correspond to the described portions of a full-length Mistic sequence. For example, the first half of SEQ ID NO: 1 (not including any fractions of a nucleotide) corresponds to nucleotides 1-166 of SEQ ID NO: 1 and so forth. Some embodiments involve Mistic nucleic acid fragments encoding alpha helices 1, 2, 3 and 4, alpha helices 2, 3 and 4, alpha helices 2 and 3, or alpha helices 3 and 4 of a Mistic polypeptide (in each instance, including polypeptide loops between the respective helices so as to maintain the relative structural positions of the helices).

IV. Mistic Polypeptides

This disclosure further provides Mistic polypeptides (including Mistic polypeptide variants) and the nucleic acid sequence encoding such polypeptides. A panel of representative Mistic polypeptides is shown in SEQ ID NO: 2, 189, 191, 193 and 195. As described in detail in the Examples, Mistic-L (SEQ ID NO: 2) was produced and isolated by expressing the corresponding nucleic sequence, which was isolated from *B. subtilis*. M1 is a functional fragment (or an alternative-start-site variant) of Mistic-L, which lacks the 26 N-terminal amino acids of Mistic-L. Nucleic acid sequences encoding M2, M3 and M4 were isolated from the genomes of *B. licheniformis, B. mojavensis,* and *B. atrophaeus*, respectively, by amplifying the regions of those genomes that corresponds to the region in the *B. subtilis* genome from which Mistic-L was (or M1 can be) isolated. The sequences and relationship among these Mistic polypeptides is shown in the amino acid alignment of FIG. 13. From the large collective of Mistic polypeptides described herein, a wealth of structural and functional information concerning this class of polypeptides is provided.

Figure 13:
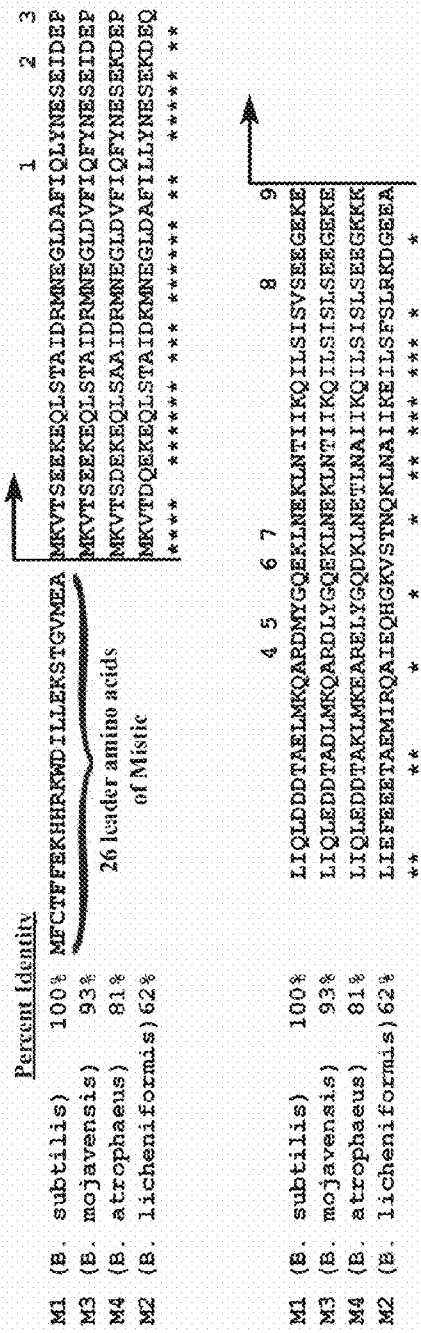
FIG. 13 is a sequence alignment of Mistic-L (including M1; SEQ ID NO: 189), M2 (SEQ ID NO: 191), M3 (SEQ ID NO: 193) and M4 (SEQ ID NO: 195). M1-M4 are each 84 residues in length. Mistic-L includes 26 N-terminal amino acids not found in the other Mistic polypeptides. Residues identical among the aligned sequences are labeled with a star (*) and overall percent identity to Mistic-L over the common 84 residues is indicated. Non-conservative substitutions are numbered 1-9.
Figure 13:
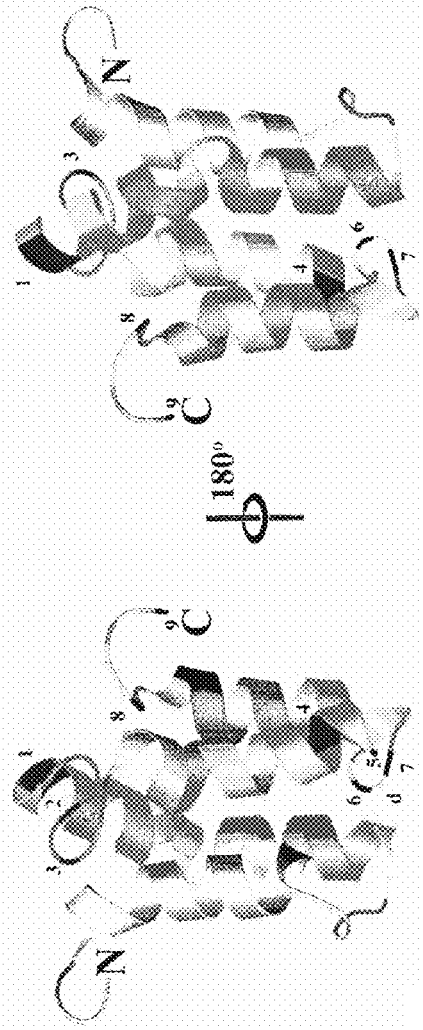

As shown in FIG. 13, the functional M1 portion of Mistic-L, M2, M3, and M4 share considerable amino acid sequence identity (indicated by asterisks in FIG. 13). Where the sequences are not identical, there is generally conservative substitution of residues among these Mistic polypeptides. There are only nine non-conservative substitutions among the 89 residues of these polypeptides. For example, 30 of the N-terminal 39 amino acid residues of M1, M2, M3, and M4 are identical with only 3 non-conservative substitutions. In another example, 26 of the N-terminal 33 amino acid residues of M1, M2, M3, and M4 are identical with only 1 non-conservative substitution. Thus, in one embodiment, a class of Mistic polypeptides is identified as including the consensus sequence: M K V T $X_1$ $X_2$ E K E Q L S $X_3$ A I D $X_4$ MN E G L D $X_5$ F I $X_6$ $X_7$ Y N E S E (SEQ ID NO: 220); wherein $X_1$ is S or D; $X_2$ is E, D or Q; $X_3$ is T or A; $X_4$ is R or K; $X_5$ is A or V; $X_6$ is any amino acid; and $X_7$ is L or F. In other embodiments, a Mistic polypeptide comprises the consensus sequence set forth in SEQ ID NO: 220, except that the residues at $X_1$-$X_7$ correspond to the M1 Mistic polypeptide residues or a very highly conserved substitution, highly conserved substitution or conserved substitution (as set forth in Table 5) of such M1 residues. Nucleic acid sequences encoding such Mistic polypeptide consensus sequences are also contemplated by this disclosure.

In yet other embodiments, a Mistic polypeptide comprises the consensus sequence: M K V T (S/D) (E/D/Q) E K E Q L S (T/A) A I D (K/R) M N E G L D (A/V) F I (Xaa) (L/F) Y N E S E (Xaa) D E (Xaa) L I (Q/E) (L/F) (D/E) (D/E) (D/E) T A (E/D/K) (L/M) (M/I) (K/R) (Q/E) A (Xaa) (D/E) (Xaa) (Y/H) G (Q/K) (Xaa) (K/S) (Xaa) N (Q/E) (Xaa) L N (T/A) I I K (Q/E) I L S (I/F) S (V/L) (Xaa) (E/K) (E/D) G (E/K) (K/E) (Xaa) (SEQ ID NO: 221), wherein amino acid residues in parentheses indicate possible residues at that position and Xaa can be any amino acid residue. In other embodiments, each Xaa in SEQ ID NO: 221 is a very highly conserved substitution, highly conserved substitution, or conserved substitution (as set forth in Table 5) of the corresponding M1 residue.

In some embodiments, Mistic polypeptides are no more than 150, no more than 140, no more than 130, no more than 120, no more than 115, or no more than 110 amino acid residues. In a particular embodiment, a Mistic polypeptide contains about 110 amino acid residues. In other embodiments, a Mistic polypeptide has a molecular mass of no more than about 30 kDa, no more than about 25 kDa, no more than about 20 kDa, no more than about 15 kDa, or no more than about 13 kDa. In a specific embodiment, a Mistic polypeptide has a molecular mass of about 13 kDa.

Figure 10A:
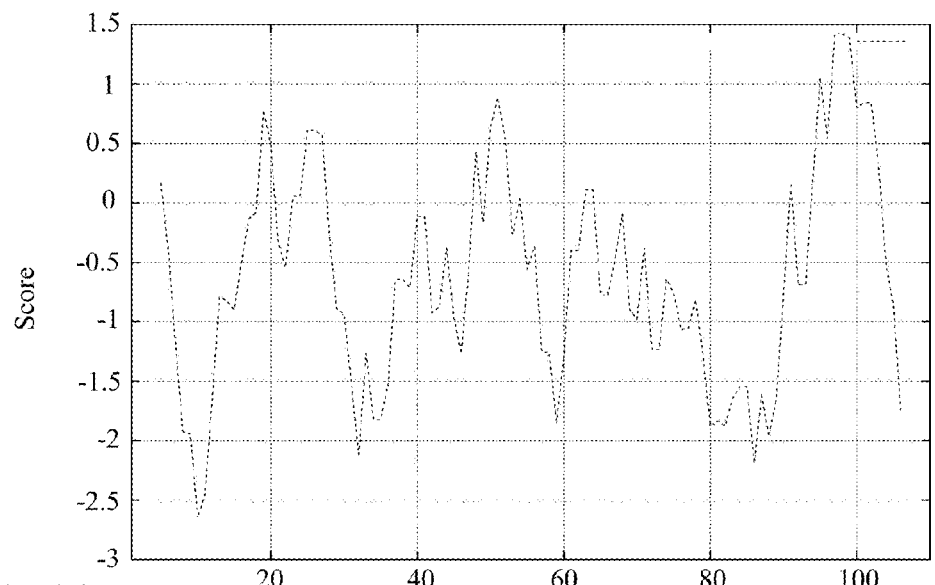
FIG. 10 shows two non-limiting representative hydropathy profiles (panels A and B) for a prototypical Mistic-L polypeptide.
Figure 10B:
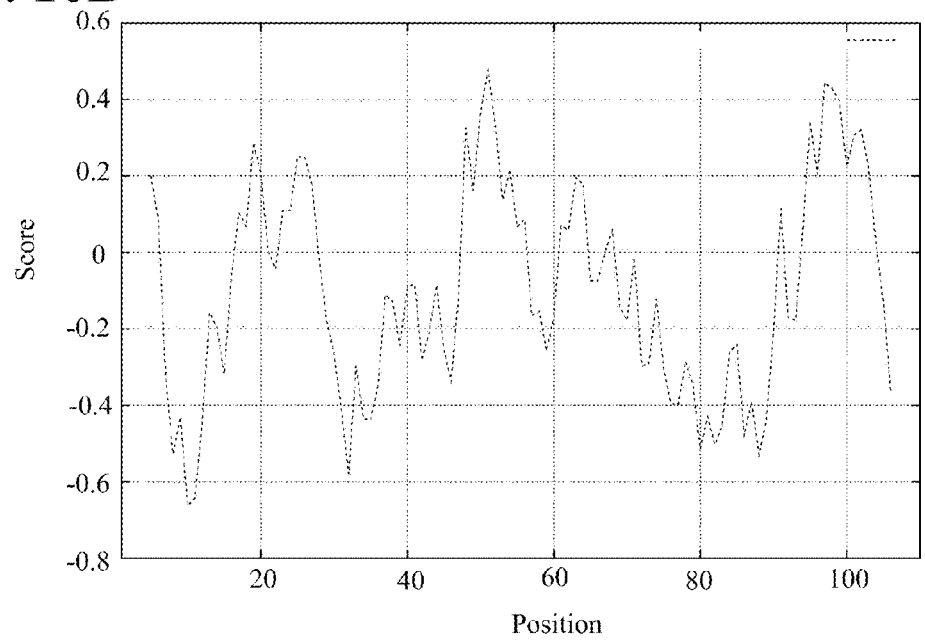

In other embodiments, a Mistic polypeptide is hydrophilic with no more than about 25%, no more than about 30%, no more than about 35%, or no more than about 40% hydrophobic residues. Hydrophobic residues include, for example, Leu, Ile, Val, Met, Phe, or Trp. In one example, approximately 33% the residues of a Mistic polypeptide are hydrophobic. Some polypeptide embodiments have hydrophobic residues dispersed (such as, substantially evenly dispersed) throughout a Mistic polypeptide sequence. Non-limiting representative hydropathy profiles for a Mistic polypeptide are shown in FIGS. 10A and 10B. In some embodiments, a Mistic polypeptide lacks any substantial stretches of contiguous hydrophobic amino acids; thus, for example, a Mistic polypeptide will have no more than about 10, no more than about 8 or no more than about 6 contiguous hydrophobic residues. A hydropathy profile of some Mistic polypeptide embodiments indicates a complete absence of predictable transmembrane helices; however, such Mistic polypeptide will still be capable of associating with a membrane or membrane-like structure.

In some examples, a Mistic polypeptide (or a functional fragment thereof) is monomeric in solubilizing detergent solution and comprises four alpha helices with up-down-up-down topology (e.g., Mistic-L) or three alpha helices with down-up-down topology (e.g., M1, M2, M3, or M4). Exemplary alpha helices include from about 10 to about 40 residues; for example, from about 10 to about 36 residues, from about 10 to about 32 residues, from about 10 to about 29 residues or from about 10 to about 25 residues. In one example, each Mistic alpha helix includes at least 10 amino acid residues and no more than 25 amino acid residues. In other examples, an alpha helix is formed by about residue 8 to about residue 22, about residue 32 to about residue 55, about residue 67 to about residue 81, and/or about residue 89 to about residue 102 of a Mistic polypeptide (in each instance ± up to about 5 residues, such as ±2 residues or ±3 residues). In more particular embodiments, an alpha helix of a Mistic polypeptide (e.g., M1, M2, M3, or M4) is formed by about residue 6 to about residue 29, about residue 41 to about residue 55, and/or about residue 63 to about residue 76 of the polypeptide (in each instance ± up to about 5 residues, such as ±2 residues or ±3 residues).

The tertiary structure of a prototypical Mistic polypeptide is also disclosed herein. Atomic structural coordinates of the representative Mistic-L are listed in Table 4 (preceding the claims) and deposited as PDB Accession No. 1YGM (release date Mar. 1, 2005). The tertiary structures of M1, M2, M3, and M4 are expected to be closely related to that of Mistic-L.

Mistic polypeptides as disclosed herein have at least one function of the Mistic prototype protein (e.g., Mistic-L, M1, M2, M3, or M4). Such Mistic polypeptide functions include, without limitation, the ability to associate (for example, autonomously associate) with a membrane (such as, a bacterial cell membrane) or a membrane-like structure (such as, a micelle or liposome), and/or to traffic a fusion partner (such as, an IM protein) to a cell membrane, and/or to stabilize the structure of a fusion partner (for example, to prevent aggregation or facilitate solubilization of an IM fusion partner).

With the provision of Mistic amino acid sequences and the corresponding nucleic acid sequences herein, the creation of Mistic polypeptide variants is now enabled. Mistic variants include polypeptides that differ in amino acid sequence from a disclosed Mistic polypeptide sequence, but that substantially retain a wild-type function and/or three-dimensional structure (as disclosed elsewhere herein). In some embodiments, Mistic variants include polypeptides that share at least 60% amino acid sequence identity with a Mistic polypeptide sequence provided herein; for example, some Mistic variants will share at least 70%, at least 75%, at least 80%, at least 85%, at least 90%, at least 95%, or at least 98% amino acid sequence identity with a disclosed Mistic sequence (for example, SEQ ID NO: 2, 189, 191, 193 or 195).

Mistic variants can be naturally occurring or produced by any method known in the art for making polypeptide variants. In some embodiments, a Mistic variant is produced by manipulation of a disclosed Mistic nucleotide sequence using standard procedures, including without limitation site-directed mutagenesis or PCR. Techniques for DNA mutagenesis have been described previously herein. Naturally occurring Mistic variants can be isolated using any of a myriad of protein purification techniques known in the art (for example, Scopes, *Protein Purification: Principles and Practice*, 3rd Edition, New York: Springer-Verlag, 1994; *Protein Purification Techniques*, 2nd Edition, ed. by Simon Roe, New York: Oxford University Press, 2001; *Membrane Protein Purification and Crystallization*, 2nd Edition, ed. by Hunte et al., San Diego: Academic Press, 2003). A nucleic acid sequence that encodes all or part of a Mistic variant can be readily determined simply by applying a genetic code to the respective portion of the variant's amino acid sequence. The nucleic acid sequence of a variant, then, can be isolated using methods described elsewhere in this specification.

Non-limiting examples of disclosed Mistic polypeptide variants include the following Mistic-L polypeptide variants: Trp13Ala (residues 21-130 of SEQ ID NO: 6); Gln36Glu (residues 21-130 SEQ ID NO: 8); Met75Ala (residues 21-130 of SEQ ID NO: 10); Cys3Val (residues 21-130 of SEQ ID NO: 12); Cys3Leu (residues 21-130 of SEQ ID NO: 14); Cys3Ile (residues 21-130 of SEQ ID NO: 16); Cys3Ser (residues 21-130 of SEQ ID NO: 18); Cys3Val/Thr30Cys (residues 21-130 of SEQ ID NO: 20); Cys3Val/Ser58Cys (residues 21-130 of SEQ ID NO: 22); Cys3Val/Asn88Cys (residues 21-130 of SEQ ID NO: 24); Cys3Val/Glu110Cys (residues 21-130 of SEQ ID NO: 26); EEGE105-108DDDD (where E=Glu, G=Gly, and D=Asp), which is collectively referred to as an "EK" variant (residues 21-130 of SEQ ID NO: 28); EK/Cys3Ser (residues 21-130 of SEQ ID NO: 30); EK/Trp13Ala residues 21-130 of SEQ ID NO: 32); EK/Gln36Glu (residues 21-130 of SEQ ID NO: 34); and EK/Met75Ala (residues 21-130 of SEQ ID NO: 36).

In some embodiments, Mistic polypeptide variants involve the substitution of one or several amino acids for amino acids having similar biochemical properties (so-called conservative substitutions). Conservative amino acid substitutions are likely to have minimal impact on the activity of the resultant protein. Further information about conservative substitutions can be found, for instance, in Ben Bassat et al. (*J. Bacteriol.*, 169:751-757, 1987), O'Regan et al. (*Gene*, 77:237-251, 1989), Sahin-Toth et al. (*Protein Sci.*, 3:240-247, 1994), Hochuli et al. (*Bio/Technology*, 6:1321-1325, 1988) and in widely used textbooks of genetics and molecular biology. The Blosum matrices are commonly used for determining the relatedness of polypeptide sequences. The Blosum matrices were created using a large database of trusted alignments (the BLOCKS database), in which pairwise sequence alignments related by less than some threshold percentage identity were counted (Henikoff et al., *Proc. Natl. Acad. Sci. USA*, 89:10915-10919, 1992). A threshold of 90% identity was used for the highly conserved target frequencies of the BLOSUM90 matrix. A threshold of 65% identity was used for the BLOSUM65 matrix. Scores of zero and above in the Blosum matrices are considered "conservative substitutions" at the percentage identity selected. The following table shows exemplary conservative amino acid substitutions:

TABLE 5

| Original Residue | Very Highly - Conserved Substitutions | Highly Conserved Substitutions (from the Blosum90 Matrix) | Conserved Substitutions (from the Blosum65 Matrix) |
|---|---|---|---|
| Ala | Ser | Gly, Ser, Thr | Cys, Gly, Ser, Thr, Val |
| Arg | Lys | Gln, His, Lys | Asn, Gln, Glu, His, Lys |
| Asn | Gln; His | Asp, Gln, His, Lys, Ser, Thr | Arg, Asp, Gln, Glu, His, Lys, Ser, Thr |
| Asp | Glu | Asn, Glu | Asn, Gln, Glu, Ser |
| Cys | Ser | None | Ala |
| Gln | Asn | Arg, Asn, Glu, His, Lys, Met | Arg, Asn, Asp, Glu, His, Lys, Met, Ser |
| Glu | Asp | Asp, Gln, Lys | Arg, Asn, Asp, Gln, His, Lys, Ser |
| Gly | Pro | Ala | Ala, Ser |
| His | Asn; Gln | Arg, Asn, Gln, Tyr | Arg, Asn, Gln, Glu, Tyr |
| Ile | Leu; Val | Leu, Met, Val | Leu, Met, Phe, Val |
| Leu | Ile; Val | Ile, Met, Phe, Val | Ile, Met, Phe, Val |
| Lys | Arg; Gln; Glu | Arg, Asn, Gln, Glu | Arg, Asn, Gln, Glu, Ser |
| Met | Leu; Ile | Gln, Ile, Leu, Val | Gln, Ile, Leu, Phe, Val |
| Phe | Met; Leu; Tyr | Leu, Trp, Tyr | Ile, Leu, Met, Trp, Tyr |
| Ser | Thr | Ala, Asn, Thr | Ala, Asn, Asp, Gln, Glu, Gly, Lys, Thr |
| Thr | Ser | Ala, Asn, Ser | Ala, Asn, Ser, Val |
| Trp | Tyr | Phe, Tyr | Phe, Tyr |
| Tyr | Trp; Phe | His, Phe, Trp | His, Phe, Trp |
| Val | Ile; Leu | Ile, Leu, Met | Ala, Ile, Leu, Met, Thr |

In some examples, Mistic variants can have no more than about 3, 5, 10, 15, 20, 25, 30, 40, or 50 conservative amino acid changes (such as, very highly conserved or highly conserved amino acid substitutions) as compared to SEQ ID NO: 2, 189, 191, 193, or 195. In other examples, one or several hydrophobic residues (such as Leu, Ile, Val, Met, Phe, or Trp) in a Mistic sequence can be replaced with a different hydrophobic residue (such as Leu, Ile, Val, Met, Phe, or Trp) to create a variant functionally similar to a disclosed Mistic polypeptide. Substitution of hydrophobic residues in a Mistic sequence can be dispersed throughout all or most of the sequence. Alternative embodiments involve hydrophobic substitutions for hydrophobic residues in a particular region of a Mistic primary sequence (such as the N-terminus (e.g., first one-third), C-terminus (e.g., last one-third) or interior (e.g., middle one-third) portions of a Mistic sequence). Still other embodiments involve substitution of hydrophobic residues with other hydrophobic residues in particular domains of a Mistic tertiary structure (for example, in the core of the Mistic-L protein, including without limitation residues 17, 44, 75 and 98, as illustrated in FIG. 3D).

Mistic-L protein function (such as, autonomous association with a membrane, protein trafficking, and/or protein stabilizing functions) is substantially maintain in, at least, the following variants: Cys3Ser (residues 21-130 of SEQ ID NO: 18); Cys3Val (residues 21-130 of SEQ ID NO: 12); Cys3Ile (residues 21-130 of SEQ ID NO: 16; Cys3Leu (residues 21-130 of SEQ ID NO: 14); Trp13Ala (residues 21-130 of SEQ ID NO: 6); Gln36Glu (residues 21-130 SEQ ID NO: 8); Cys3Val/SerS8Cys (residues 21-130 of SEQ ID NO: 22); Cys3Val/Asn88Cys (residues 21-130 of SEQ ID NO: 24); Cys3Val/Glu110Cys (residues 21-130 of SEQ ID NO: 26); and EEGE105-108DDDD (where E=Glu, G=Gly, and D=Asp) (residues 21-130 of SEQ ID NO: 28). As is readily apparent from this panel of Mistic-L mutants, residues dispersed throughout the 110 amino acid prototypic Mistic-L polypeptide can be modified without substantial effect on protein function. Moreover, as demonstrated, even non-conservative mutations at various sites throughout the prototypic Mistic-L sequence are well tolerated. In comparison, a Met75Ala Mistic-L mutant loses, at least, its ability to traffic a fusion partner (also referred to as a "cargo protein") to the membrane (see Example 5). Thus, Mistic-L variants preferably retain Met75.

From the amino acid sequence alignment of Mistic-L (including M1), M2, M3, and M4 (see FIG. 13), the residues in M1, M2, M3, and M4 corresponding to the Mistic-L point mutants readily can be determined. It is expected that analogous amino acid substitutions can be made in M1, M2, M3, and/or M4 with the corresponding effect (typically, no substantial effect) on a function of those Mistic polypeptides.

It is expected that mutations that substantially maintain the three-dimensional structure of a Mistic polypeptide will have little effect on its function. The provision of the Mistic-L three-dimensional structure herein enables the design of structurally equivalent, functional Mistic polypeptide variants. As shown, for instance, in Example 3, Mistic-L comprises four, anti-parallel alpha helices. M1, M2, M3 and M4 lack the N-terminus (including helix 1) of Mistic-L (see, e.g., FIG. 13) and are believed to comprise three, anti-parallel alpha helices. As known to those of skill in the art, alpha helices are destabilized by (i) the substitution of Pro for any helix-resident amino acid, (ii) Asp adjacent to Glu in a helix, or (iii) a cluster of Ile residues (such as, 3 or more contiguous Ile residues) in a helix. Accordingly, Mistic polypeptide variants preferably avoid helix destabilizing mutations.

As demonstrated herein, at least the N-terminal 26 amino acids of Mistic-L (or any smaller subset thereof) are not necessary for a function of the resultant, M1 Mistic polypeptide. Accordingly, Mistic variants that are functional fragments of a full-length Mistic polypeptide are also envisioned herein. In one embodiment, a functional fragment of a Mistic polypeptide comprises (or consists of) a Mistic-L sequence (e.g., SEQ ID NO: 2) that lacks up to 2, up to 5, up to 8, up to 10, up to 12, up to 15, up to 18, up to 20, up to 22, or up to all 26 of the N-terminal amino acids. Moreover, because it tolerates non-conservative substitutions, it is believed that the C-terminal non-helical "tail" of Mistic-L, M1, M2, M3, and M4 can be removed without substantial adverse effect on a function of the corresponding Mistic polypeptide. Thus, in another embodiment, a functional fragment of a Mistic polypeptide lacks from up to 2, up to 5, up to 6, up to 8, up to 10, up to 12, up to 15, up to 20, or up to 25 C-terminal amino acids. A functional fragment of a Mistic polypeptide retains at least one functional activity of the polypeptide from which the fragment is obtained, including, e.g., membrane-associating activity and/or the ability to stabilize a fusion partner.

Fusion proteins comprising Mistic polypeptides (also referred to as "Mistic fusion proteins") are also contemplated by this disclosure. As demonstrated herein, such fusion proteins are useful, at least, for guiding a variety of Mistic fusion partners to a membrane (such as, a cell membrane) or a membrane-like structure (such as, a micelle or liposome). Among other things, this Mistic polypeptide trafficking function enables new methods of producing or isolating recombinant proteins (as discussed below).

Any protein can be fused to all or part of a disclosed Mistic polypeptide (referred to as a "Mistic domain"). In some embodiments, a soluble protein or a membrane protein (such as, an IM protein) is fused to a Mistic domain. One of ordinary skill in the art will recognize that a soluble protein is not substantially incorporated into a membrane or membrane-like structure even though under native conditions a soluble protein may interact, for instance, with elements of the cellular cytoskeleton and not be freely diffusible within a cell. Similarly, the ordinarily skilled artisan will understand that a membrane protein (such as, an IM protein) may have domains that are located outside the lipid bilayer, for example, in an intra- or extra-cellular space.

In some embodiments, a Mistic domain is fused (directly or indirectly) to all or part of an IM protein, including a $K^+$ channel protein, a G-protein coupled receptor, or a TGF-β family receptor protein. In more specific embodiments, a $K^+$ channel protein includes those listed in Table 3. In other specific embodiments, a G-protein coupled receptor includes those listed in Table 3. In still other specific embodiments, a TGF-β family receptor protein includes those listed in Table 3.

The various elements or domains of a Mistic fusion protein can be arranged in any order between the N-terminal and C-terminal ends of the fusion protein. An element or domain that is closer to the N-terminus of a Mistic fusion protein than another element or domain is said to be "N-terminal" of the other element or domain. Similarly, an element or domain that is closer to the C-terminus of a Mistic fusion protein than another element or domain is said to be "C-terminal" of the other element or domain. Unless expressly stated otherwise, different elements or domains of a Mistic fusion protein need not (but may) be adjacent (that is, without one or more intervening elements or domains).

In some Mistic fusion protein embodiments, a Mistic domain (e.g., Mistic-L, M1, M2, M3, or M4, or a functional fragment of any thereof) is N-terminal or C-terminal with respect to a fusion partner (e.g., cargo protein) domain. In other embodiments, a fusion partner protein may be interrupted or divided by a Mistic domain to form two separate domains of a Mistic fusion protein; for example, a Mistic domain may be located between particular functional regions of a particular fusion partner protein, or may divide a fusion partner protein into approximately equal halves, or may be inserted approximately one-fourth, one-third, two-thirds, or three-quarters into the fusion partner protein sequence.

A Mistic fusion protein can include one or more optional elements, such as one or more linker(s), peptide tags (such as, epitope tags), protease-recognition site(s), and/or exogenous helix(ces). A linker is a relatively short series of amino acids that separates other elements or domains of a Mistic fusion protein. For example, a linker can separate a Mistic domain (e.g., Mistic-L, M1, M2, M3, or M4, or a functional fragment of any thereof) and a fusion partner (e.g., cargo protein) domain. In some instances, a linker may be referred to as including another fusion protein element, such as a protease-recognition site or a peptide tag. In some embodiments, a linker is from 1 to 100 amino acids in length; for example, from 5 to 75, from 10 to 60, from 15 to 50, from 15 to 40, or from 1 to 50 amino acids in length. In specific embodiments, a linker has a sequence such as set forth in SEQ ID NO: 40, 42, 44, 46, 48, or 50.

A peptide tag is a, typically short, amino acid sequence (for example, from 1 to 30 amino acids, such as from 4 to 20, or from 4 to 15 amino acid residues) that permits the tagged protein to be readily detected or purified, for example, by affinity purification. Any peptide tag can be used as long as it is capable of being expressed as an element of a Mistic fusion protein and is capable of, for instance, facilitating detection or purification of the fusion protein. A peptide tag is generally (but need not be) placed at or near the N- or C-terminus of a Mistic fusion protein domain, such as a Mistic domain (e.g., Mistic-L, M1, M2, M3, or M4, or a functional fragment of any thereof) or a fusion partner domain. In particular embodiments, a tag is placed at or near the N-terminus of a Mistic domain and/or at or near the C-terminus of a fusion partner (e.g., cargo protein) domain. Various peptide tags are well known in the art. Non-limiting examples include poly-histidine tag (e.g., 4 to 15 consecutive His residues, such as 8 consecutive H is residues), poly-histidine-glycine tag; HA tag (e.g., Field et al., *Mol. Cell. Biol.*, 8:2159, 1988), c-myc tag (e.g., Evans et al., *Mol. Cell. Biol.*, 5:3610, 1985), Herpes simplex virus glycoprotein D (gD) tag (e.g., Paborsky et al., *Protein Engineering*, 3:547, 1990), FLAG tag (e.g., Hopp et al., *BioTechnology*, 6:1204, 1988; U.S. Pat. Nos. 4,703,004 and 4,851,341), KT3 epitope tag (e.g., Martine et al., *Science*, 255:192, 1992), tubulin epitope tag (e.g., Skinner, *Biol. Chem.*, 266:15173, 1991), T7 gene 10 protein peptide tag (e.g., Lutz-Freyermuth et al., *Proc. Natl. Acad. Sci. USA*, 87:6393, 1990), streptavidin tag (StrepTag™ or StrepTagII™; see, e.g., Schmidt et al., *J. Mol. Biol.*, 255(5): 753-766, 1996 or U.S. Pat. No. 5,506,121; also commercially available from Sigma-Genosys), or a biotinylation peptide tag (BioTag™, which can be specifically biotinylated in vivo or in vitro at a single lysine residue within the tag; e.g., U.S. Pat. Nos. 5,723,584; 5,874,239; and 5,932,433; and U.K Pat. No. GB2370039). Numerous other tag moieties are known to, and can be envisioned by, the ordinarily skilled artisan, and are contemplated herein. An "epitope tag" is a particular type of peptide tag that adds a recognizable epitope (antibody binding site) to the Mistic fusion protein to provide binding of a corresponding antibody; thereby allowing identification or affinity purification of the tagged protein.

A protease-recognition site is an amino acid sequence specifically recognized for cleavage by a particular protease. Protease recognition sites are useful, for example, to cleave one or more Mistic fusion protein domain(s) from each other and/or to isolate a particular Mistic fusion domain (such as, a fusion partner (e.g., cargo protein) domain). Protease-recognition sites are known in the art and proteases specific for such protease-recognition sites are commercially available. Exemplar proteases (and their corresponding recognition sites) include, for example, Tobacco Etch Virus (TEV) NIa protease (Glu-X-X-Tyr-X-Gln/Ser, wherein cleavage occurs between the conserved Gln and Ser residues; Dougherty et al., *Virol.*, 171:356-364, 1989); factor Xa protease (Ile-Glu-Gly-Arg, wherein the C-terminal peptide bond is cleaved); PreScission™ protease (Leu-Glu-Val-Leu-Phe-Gln/Gly-Pro) (available from Amersham Biosciences); serine protease enterokinase (EK) (Asp-Asp-Asp-Asp-Lys, wherein the C-terminal peptide bond is cleaved) (available from Stratagene), or thrombin (Arg-Gly). Other useful proteases, whose recognition sites are known in the art, include chymotrypsin, trypsin, plasmin, papain, pepsin, and subtilisin.

An exogenous helix is an optional alpha helical domain of a Mistic fusion protein that is distinct from either a Mistic domain or a fusion partner domain. An exogenous helix can facilitate an appropriate orientation of a Mistic domain and its fusion partner domain in a membrane. This is useful, for example, in a situation where the fused termini of Mistic and its fusion partner are naturally located on opposite sides of a membrane.

An exogenous helix includes any series of amino acids that fold into an alpha helix when expressed as a Mistic fusion protein domain. In some examples, an exogenous helix is of sufficient length to traverse a membrane (such as, a cell membrane); for example, an exogenous helix may be from about 5 to about 25 amino acids in length. An exogenous helix sequence can be synthetic or derived from a naturally occurring protein. In some examples, the amino acid sequence of an exogenous helix differs from the sequence of an alpha helix of a Mistic domain or a fusion partner (e.g., cargo protein) domain. In particular embodiments, an exogenous helix has the sequence of a *Pseudomonas* K$^+$ channel S1 domain, or as set forth in SEQ ID NO: 181. In other embodiments, a synthetic exogenous helix has a sequence set forth in residues 131-184 of SEQ ID NO: 114 or in SEQ ID NOs: 182-183 (see also, Wimley and White, *Biochem.*, 39:4432-4442, 2000).

Representative Mistic fusion proteins include, for instance, the polypeptides (and corresponding nucleic acid sequences) shown in the following Table 1.

TABLE 1

Representative Mistic Fusion Constructs

| Fusion Protein | SEQ ID NO. NT | SEQ ID NO. AA |
|---|---|---|
| pMistic-KchBsu265 | 51 | 52 |
| pMistic(EK)-KchBsu265 | 53 | 54 |
| pMistic(EK)-KchXfa297 | 55 | 56 |
| pMistic(EK)-Link-KchMja209 | 57 | 58 |
| pMistic(EK)-Link-KchPae283 | 59 | 60 |
| pMistic-Link-KchPae283 | 61 | 62 |
| pMistic-Thr-KchPae283 | 63 | 64 |
| pMistic(EK/C3S)-Link-KchPae283 | 65 | 66 |
| pMistic(C3V)-Thr-KchPae283 | 67 | 68 |
| pMistic(C3I)-Thr-KchPae283 | 69 | 70 |
| pMistic(C3L)-Thr-KchPae283 | 71 | 72 |
| pMistic(C3V/T30C)-Thr-KchPae283 | 73 | 74 |
| pMistic(C3V/S58C)-Thr-KchPae283 | 75 | 76 |
| pMistic(C3V/N88C)-Thr-KchPae283 | 77 | 78 |
| pMistic(C3V/E110C)-Thr-KcbPae283 | 79 | 80 |
| pMistic(EK)-aKv1.1 ΔT1 | 81 | 82 |
| pMistic(EK/W13A)-aKv1.1ΔT1 | 83 | 84 |
| pMistic(EK/Q36E)-aKv1.1ΔT1 | 85 | 86 |
| pMistic(EK/M75A)-aKv1.1ΔT1 | 87 | 88 |
| pMistic(EK)-aKv1.1 | 89 | 90 |
| pMistic(EK)-L-aKv1.1(Δ1-6) | 91 | 92 |
| pMistic(EK)-LI-aKv1.1(Δ1) | 93 | 94 |
| pMistic(EK)-LINKER-aKv1.1 | 95 | 96 |
| pMistic(EK)-LINK-hKv1.5 | 97 | 98 |
| pMistic(EK)-LINK-rKv2.1 | 99 | 100 |
| pMistic(EK)-LINK-rKv3.1 | 101 | 102 |
| pMistic(EK)-LINK-rKv1.2 | 103 | 104 |
| pMistic(EK)-LINK2-rKv1.2 | 105 | 106 |
| pMistic(EK)-LINK-GABABR1 | 107 | 108 |
| pMistic(EK)-LINK-VIPR2 | 109 | 110 |
| pMis-Alk2 | 115 | 116 |
| pMisT-Alk2 | 117 | 118 |
| pMis-Alk3 | 119 | 120 |
| pMisT-Alk3 | 121 | 122 |
| pMis-Alk5 | 123 | 124 |
| pMisT-Alk5 | 125 | 126 |
| pMis-Alk6 | 127 | 128 |
| pMisT-Alk6 | 129 | 130 |
| pMis-ActRII | 131 | 132 |
| pMisT-ActRII | 133 | 134 |
| pMis-ActRIIb | 135 | 136 |
| pMisT-ActRIIb | 137 | 138 |
| pMis-BMPRII | 139 | 140 |
| pMisT-BMPRII | 141 | 142 |
| pMis-CRFR1 | 143 | 144 |
| pMisT-CRFR1 | 145 | 146 |
| pMis-CRFR2β | 147 | 148 |
| pMisT-CRFR2β | 149 | 150 |
| pMis-CD97 | 151 | 152 |
| pMisT-CD97 | 153 | 154 |
| pMis-CCR5 | 155 | 156 |
| pMisT-CCR5 | 157 | 158 |
| pMis-RAI3 | 159 | 160 |
| pMisT-RAI3 | 161 | 162 |
| pMis-GPRC5B | 163 | 164 |
| pMisT-GPRC5B | 165 | 166 |
| pMis-ETL | 167 | 168 |
| pMisT-ETL | 169 | 170 |
| pMis-GABABR1 | 171 | 172 |
| pMisT-GABABR1 | 173 | 174 |
| pMis-VIPR2 | 175 | 176 |
| pMisT-VIPR2 | 177 | 178 |
| His/Linker-M1-Link-Alk3 | 196 | 197 |
| His/Linker-M1-Link-BMPRII | 198 | 199 |
| His/Linker-M1-Link-CRFR2β | 200 | 201 |
| His/Linker-M2-Link-Alk3 | 202 | 203 |
| His/Linker-M2-Link-BMPRII | 204 | 205 |
| His/Linker-M2-Link-CRFR2β | 206 | 207 |
| His/Linker-M3-Link-Alk3 | 208 | 209 |
| His/Linker-M3-Link-BMPRII | 210 | 211 |
| His/Linker-M3-Link-CRFR2β | 212 | 213 |
| His/Linker-M4-Link-Alk3 | 214 | 215 |
| His/Linker-M4-Link-BMPRII | 216 | 217 |
| His/Linker-M4-Link-CRFR2β | 218 | 219 |

The fusion proteins in Table 1 are shown as domains (or modules) fused together with a hyphen ("-") representing a linkage point between contiguous domains. A pMis, pMisT, pMistic, or pMistic( . . . ) module includes a Mistic-L amino acid sequence with or without additional functional elements, such as an octa-his tag (e.g., pMis, pMisT, pMistic, or pMistic( . . . )), a linker (e.g., pMis, or pMisT), an exogenous helix (e.g., pMisT), and/or an indicated mutation (e.g., pMistic( . . . )). A linker is represented in some of exemplary Mistic fusion proteins by "Link", "L", "LI", "LINKER", "LINK", or "LINK2". Some such linkers (e.g., Link, LINKER, LINK and LINK2) also include a thrombin cleavage site. A thrombin protease cleavage site module is denoted in some constructs as "Thr". Numerous representative Mistic fusion partner domains (also referred to as cargo protein domains), including a variety of potassium channel proteins, G-protein linked receptor proteins, and TGF-β family receptor proteins, are shown above with designations well known in the art (see also, Table 3 herein). Such designations include KchBsu265, KchXfa297, KchMja209, KchPae283, aKv1.1 ΔT1, aKv1.1DT1, aKv1.1, aKv1.1(Δ1-6), aKv1.1(Δ1), hKv1.5, rKv2.1, rKv3.1, rKv1.2, GABABR1, VIPR2, Alk2, Alk3, Alk5, Alk6, ActRII, ActRIIb, BMPRII, CRFR1, CRFR2β, CD97, CCR5, RAI3, GPRC5B, and ETL. The particular arrangement (and corresponding amino acid residues) of functional elements in the foregoing Mistic fusion proteins are shown with particularity in the Sequence Listing.

Methods of making fusion proteins are well known in the art. Fusion proteins can be produced recombinantly by constructing a nucleic acid sequence which encodes the N-terminal fusion protein domain in frame with a nucleic acid sequence encoding the next fusion protein domain (or element) and so forth. Appropriate molecular biological techniques may be found in Sambrook et al. (*Molecular Cloning: A Laboratory Manual*, New York: Cold Spring Harbor Laboratory Press, 1989). Specific examples of genetically engineered multi-domain fusion proteins can be found in U.S. Pat. Nos. 5,834,209; 5,821,082; 5,696,237; 5,668,255; and 5,587,455; and in International Pub. Nos. WO 98/17682 and WO 98/12328. Alternatively, a fusion protein can be produced chemically by crosslinking the fusion protein domains (and/or elements) one to the other in the desired sequence.

V. Heterologous Expression of Recombinant Mistic and Mistic Fusion Protein

Various commonly known systems are available for heterologous expression of the disclosed Mistic polypeptides (e.g., Mistic-L, M1, M2, M3, or M4, or variants or functional fragments of any thereof) and Mistic fusion proteins, including eukaryotic and prokaryotic expression systems, and cell-free translation systems.

Methods of expressing proteins in heterologous expression systems are well known in the art. Typically, a nucleic acid molecule encoding all or part of a protein of interest (such as a Mistic polypeptide or a Mistic fusion protein) is obtained using methods such as those described herein. The protein-encoding nucleic acid sequence is cloned into an expression vector that is suitable for the particular host cell of interest using standard recombinant DNA procedures. Expression vectors include (among other elements) regulatory sequences (e.g., promoters) that can be operably linked to the desired protein-encoding nucleic acid molecule to cause the expression of such nucleic acid molecule in the host cell. Together, the regulatory sequences and the protein-encoding nucleic acid sequence are an "expression cassette." Expression vectors may also include an origin of replication, marker genes that provide phenotypic selection in transformed cells, one or more other promoters, and a polylinker region containing several restriction sites for insertion of heterologous nucleic acid sequences.

Expression vectors useful for expression of heterologous protein(s) in a multitude of host cells are well known in the art, and some specific examples are provided herein. The host cell is transfected with (or infected with a virus containing) the expression vector using any method suitable for the particular host cell. Such transfection methods are also well known in the art and non-limiting exemplar methods are described herein. The transfected (also called, transformed) host cell is capable of expressing the protein encoded by the corresponding nucleic acid sequence in the expression cassette. Transient or stable transfection of the host cell with one or more expression vectors is contemplated by the present disclosure.

Many different types of cells may be used to express heterologous proteins, such as bacteria, yeasts, fungi, insects, vertebrate cells (such as mammalian cells), and plant cells, including (as appropriate) primary cells and immortal cell lines. Numerous representatives of each cell type are commonly used and are available from a wide variety of commercial sources, including, for example, ATCC, Pharmacia, and Invitrogen.

Further details of some specific embodiments are discussed below.

A. Prokaryotes

Prokaryotes, such as bacteria, may be used as host cells. Prokaryotic expression systems are advantageous, at least, because of culture affordability, ease of genetic manipulation, and high yields of desired product(s). Suitable prokaryotic host cells include, without limitation, *E. coli* K12 strain 94 (ATCC No. 31,446), *E. coli* strain W3 110 (ATCC No. 27,325), *E. coli* X1776 (ATCC No. 31,537), *E. coli* B, and many other strains of *E. coli*, such as HB101, JM101, NM522, NM538, NM539, B1-21, B1-21 (DE3), B1-21 (DE3) pLysS, Origami B, OmpT-defective CD41, CD43 (DE3), and phosphatidylenthanolamine (PE)-deficient AD93. Similarly, other species and genera of prokaryotes including bacilli such as *Bacillus subtilis, B. mojavensis, B. atrophaeus,* or *B. licheniformis,* or other enterobacteriaceae, such as *Salmonella typhimurium* or *Serratia marcesans,* and various *Pseudomonas* species may all be used as prokaryotic expression hosts. Particular examples contemplate the use of protease-attenuated bacterial host strains such as membrane protease OmpT-defective *E. coli* (Quick and Wright, *Proc. Natl. Acad. Sci. USA,* 99:8597-8601, 2002).

Prokaryotic host cells or other host cells with rigid cell walls may be transformed using any method known in the art, including, for example, calcium phosphate precipitation, or electroporation. Representative prokaryote transformation techniques are described in Dower (*Genetic Engineering, Principles and Methods,* 12:275-296, Plenum Publishing Corp., 1990) and Hanahan et al. (*Meth. Enzymol.,* 204:63, 1991).

Vectors typically used for transformation of *E. coli* include, without limitation, pBR322, pUC18, pUC19, pUCI18, pUC19, Bluescript M13 and derivatives thereof. Numerous such plasmids are commercially available and are well known in the art. Representative promoters used in prokaryotic vectors include the β-lactamase (penicillinase) and lactose promoter systems (Chang et al., *Nature,* 375:615, 1978; Itakura et al., *Science,* 198:1056, 1977; Goeddel et al., *Nature,* 281:544, 1979), a tryptophan (trp) promoter system (Goeddel et al., *Nucl. Acids Res.,* 8:4057, 1980), and the alkaline phosphatase system.

Example 7 describes representative vectors useful for expression of disclosed Mistic polypeptides (including Mistic fusion proteins), for instance, in bacteria (such as *E. coli*).

B. Yeast

Various yeast strains and yeast-derived vectors are used commonly for the expression of heterologous proteins. For instance, *Pichia pastoris* expression systems, obtained from Invitrogen (Carlsbad, Calif.), may be used to express the disclosed Mistic polypeptides. Such systems include suitable *Pichia pastoris* strains, vectors, reagents, transformants, sequencing primers, and media. Available strains include KM71H (a prototrophic strain), SMD1168H (a prototrophic strain), and SMD1168 (a pep4 mutant strain) (Invitrogen).

*Saccharomyces cerevisiae* is another yeast that is commonly used in heterologous expression systems. The plasmid YRp7 (Stinchcomb et al., *Nature,* 282:39, 1979; Kingsman et al., *Gene,* 7:141, 1979; Tschemper et al., *Gene,* 10:157, 1980) is commonly used as an expression vector in *Saccharomyces.* This plasmid contains the trp1 gene that provides a selection marker for a mutant strain of yeast lacking the ability to grow in tryptophan, such as strains ATCC No. 44,076 and PEP4-1 (Jones, *Genetics,* 85:12, 1977). The presence of the trp1 lesion as a characteristic of the yeast host cell genome then provides an effective environment for detecting transformation by growth in the absence of tryptophan.

Yeast host cells can be transformed using the polyethylene glycol method, as described by Hinnen (*Proc. Natl. Acad. Sci. USA,* 75:1929, 1978). Additional yeast transformation protocols are set forth in Gietz et al. (*Nucl. Acids Res.,* 20(17):1425, 1992) and Reeves et al. (*FEMS,* 99(2-3):193-197, 1992).

Suitable promoting sequences in yeast vectors include the promoters for 3-phosphoglycerate kinase (Hitzeman et al., *J. Biol. Chem.,* 255:2073, 1980) or other glycolytic enzymes (Hess et al., *J. Adv. Enzyme Reg.,* 7:149, 1968; Holland et al., *Biochemistry,* 17:4900, 1978), such as enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phosphoglucose isomerase, and glucokinase. In the construction of suitable expression vectors, the termination sequences associated with these genes are also ligated into the expression vector 3' of the sequence desired to be expressed to provide polyadenylation of the mRNA and termination. Other promoters that have the additional advantage of transcription controlled by growth conditions are the promoter region for alcohol dehydrogenase 2, isocytochrome C, acid phosphatase, degradative enzymes associated with nitrogen metabolism, and the aforementioned glyceraldehyde-3-phosphate dehydrogenase, and enzymes responsible for maltose and galactose utilization. Any plasmid vector containing yeast-compatible promoter, origin of replication and termination sequences is suitable.

C. Baculovirus-infected Insect Cells

Another representative eukaryotic expression system involves the recombinant baculovirus, *Autographa californica* nuclear polyhedrosis virus (AcNPV; Summers and Smith, *A Manual of Methods for Baculovirus Vectors and Insect Cell Culture Procedures,* 1986; Luckow et al., *Biotechnol.,* 6:47-55, 1987). Infection of insect cells (such as cells of the species *Spodoptera frugiperda*) with recombinant baculoviruses results in the expression Mistic polypeptides (e.g., Mistic-L, M1, M2, M3, or M4, or variants or functional fragments of any thereof) and Mistic fusion proteins in the insect cells. Baculoviruses do not infect humans and can therefore be safely handled in large quantities.

A baculovirus expression vector is prepared as previously described using standard molecular biology techniques. The vector may comprise the polyhedron gene promoter region of a baculovirus, the baculovirus flanking sequences necessary for proper crossover during recombination (the flanking sequences comprise about 200-300 base pairs adjacent to the promoter sequence) and a bacterial origin of replication which permits the construct to replicate in bacteria. In particular examples, the vector is constructed so that (i) a Mistic polypeptide-encoding nucleic acid sequence is operably linked to the polyhedron gene promoter (collectively, the "expression cassette") and (ii) the expression cassette is flanked by the above-described baculovirus flanking sequences.

Insect host cells (such as, *Spodoptera frugiperda* cells) are infected with a recombinant baculovirus and cultured under conditions allowing expression of the baculovirus-encoded Mistic polypeptide (including Mistic fusion proteins). The expressed protein may, if desired, be extracted from the insect cells using methods known in the art or as described herein.

D. Mammalian Cells

Mammalian host cells may also be used for heterologous expression of a disclosed Mistic polypeptide (e.g., Mistic-L, M1, M2, M3, or M4, or variants or functional fragments of any thereof) and/or a Mistic fusion protein. Examples of suitable mammalian cell lines include, without limitation, monkey kidney CV1 line transformed by SV40 (COS-7, ATCC CRL 1651); human embryonic kidney line 293S (Graham et al., *J. Gen. Virol.,* 36:59, 1977); baby hamster kidney cells (BHK, ATCC CCL 10); Chinese hamster ovary cells (Urlab and Chasin, *Proc. Natl. Acad. Sci USA,* 77:4216, 1980); mouse sertoli cells (TM4, Mather, *Biol. Reprod.,* 23:243, 1980); monkey kidney cells (CV1-76, ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor cells (MMT 060562, ATCC CCL 5 1); rat hepatoma cells (HTC, MI.54, Baumann et al., *J. Cell Biol.,* 85:1, 1980); and TRI cells (Mather et al., *Annals N.Y. Acad. Sci.,* 383:44, 1982). Expression vectors for these cells ordinarily include (if necessary) DNA sequences for an origin of replication, a promoter located 5' of the nucleic acid sequence to be expressed, a ribosome binding site, an RNA splice site, a polyadenylation site, and/or a transcription terminator site.

Promoters used in mammalian expression vectors can be of viral origin. Such viral promoters may be derived from polyoma virus, adenovirus 2, and simian virus 40 (SV40). The SV40 virus contains two promoters that are termed the early and late promoters. These promoters are useful because they are both easily obtained from the virus as one nucleic acid fragment that also contains the viral origin of replication (Fiers et al., *Nature,* 273:113, 1978). Smaller or larger SV40 DNA fragments may also be used, provided they contain the approximately 250-bp sequence extending from the HindIII site toward the BglI site located in the viral origin of replication. Alternatively, promoters that are naturally associated with the foreign gene (homologous promoters) may be used provided that they are compatible with the host cell line selected for transformation.

An origin of replication may be obtained from an exogenous source, such as SV40 or other virus (e.g., polyoma virus, adenovirus, VSV, BPV) and inserted into the expression vector. Alternatively, the origin of replication may be provided by the host cell chromosomal replication mechanism.

E. Cell-Free Translation

Cell-free translation systems are known in the art, and can be used to synthesize the disclosed Mistic polypeptides (including Mistic fusion proteins) (see, e.g., Kurland, *Cell,* 28:201-202, 1982; Pavlov and Ehrenberg, *Arch. Biochem. Biophys.,* 328:9-16, 1996). The most frequently used cell-free translation systems consist of extracts from rabbit reticulocytes, wheat germ and *E. coli*. All are prepared as crude extracts containing all the macromolecular components (70S or 80S ribosomes, tRNAs, aminoacyl-tRNA synthetases, initiation, elongation and termination factors, etc.) required for translation of exogenous RNA. Each extract is supplemented with amino acids, energy sources (ATP, GTP), energy regenerating systems (creatine phosphate and creatine phosphokinase for eukaryotic systems, and phosphoenol pyruvate and pyruvate kinase for the *E. coli* lysate), and other co-factors ($Mg^{2+}$, $K^+$, etc.) that facilitate the function of the particular translation machinery.

Either DNA or RNA can be used as the starting material for cell-free protein synthesis. However, DNA starting material is necessarily transcribed to RNA using a "coupled" or "linked" system. A "linked" system generally involves DNA transcription with a bacteriophage polymerase followed by translation in the rabbit reticulocyte lysate or wheat germ lysate. Unlike eukaryotic systems (such as, rabbit reticulocyte or wheat germ) where transcription and translation occur sequentially, transcription and translation occur simultaneously in *E. coli*. Thus, *E. coli* translation systems are "coupled" and can be performed in the same tube using either a DNA or RNA template. Methods of using *E. coli* cell-free systems have been described in detail (e.g., Kigawa et al., *FEBS Lett.,* 442:15-19, 1999; Noren et al., *Science,* 244:182-188, 1989), Hanes and Plukthun, *Proc. Natl. Acad. Sci. USA,* 94:4937-4942, 1997, Wilson et al., *Proc. Natl. Acad. Sci. USA* 98, 3750-3755, 2001; Sawasaki, *Proc. Natl. Acad. Sci. USA,* 99(23): 14652-14657, 2002). In the *E. coli* system, it may be advantageous to place a Shine-Dalgarno ribosome binding site upstream of the initiator codon in a DNA template. In particular examples, an *E. coli* S30 extract system allows expression from DNA vectors containing natural *E. coli* promoter sequences (such as lac or tac).

Commercially available cell-free translation products (also referred to as in vitro translation products) and instructions for use may be purchased from Ambion (e.g., PROTEIN-script-PRO™ Kit, Retic Lysate IVT™ Kit), Roche Diagnostics (e.g., RTS 500 ProteoMaster *E. coli* HY Kit, RTS 9000 *E. coli* HY Kit), Qiagen (e.g., EasyXpress™ Protein Synthesis Kit), Promega (e.g., TNT® T7 Quick Coupled Transcription/Translation System), and numerous other suppliers.

In some embodiments, a membrane, membrane fragments, or membrane-like structures are added to, or are present in, the cell-free translation system to provide a hydrophobic structure with which a Mistic polypeptide (e.g., Mistic-L, M1, M2, M3, or M4, or variants or functional fragments of any thereof) or, as applicable, a Mistic fusion partner may associate.

VI. Methods of Using Mistic and Mistic Fusion Proteins

Disclosed herein are methods of using Mistic polypeptides (e.g., Mistic-L, M1, M2, M3, or M4, or variants or functional fragments of any thereof), including Mistic fusion proteins, and the corresponding nucleic acid sequences. Such methods contemplate the use of any of the disclosed Mistic polypeptides and/or corresponding nucleic acid sequences, such as those any of those described in the preceding sections or the Examples (below).

Methods of producing a recombinant protein are envisioned. Such methods involve expressing a recombinant fusion protein, which includes, at least, a Mistic domain and a cargo protein domain, in an expression system having a membrane or membrane-like structure, such that at least a portion of the fusion protein is associated with the membrane or membrane-like structure (for example, all or part of the fusion protein may be incorporated into the membrane or membrane-like structure). Representative expression systems, including, for example, bacteria (such as, *E. coli*) are described elsewhere in this specification. In some examples, a Mistic polypeptide or a Mistic fusion protein co-fractionates with its associated membrane under conditions that do not otherwise solubilize or destabilize the membrane or substantially disrupt the structural integrity of the membrane. Certain examples, where all or part of a polypeptide is incorporated in a membrane (or membrane-like structure), envision insertion of all or part of the polypeptide into or among the molecules (such as, lipids (e.g., phospholipids), or amphipathic molecules (e.g., detergents) that make up the membrane (or membrane-like structure).

In specific embodiments, substantially all or a portion of the Mistic domain is incorporated into the cell membrane (or membrane-like structure) (see, for example, FIG. 4A or 15); for example, at least one Mistic alpha helix is incorporated into the cell membrane (or, in more specific examples, at least four or at least three Mistic alpha helices (such as helices 1-4 or helices 2-4) are incorporated into the cell membrane). In some cases, less than about 50, less than about 35, less than about 25 of amino acids of the Mistic domain protrude from the membrane; for example, C- and/or N-terminal amino acids of the Mistic domain may protrude from the membrane. In other examples, all or part of a cargo protein domain will be incorporated into the membrane. The extent to which a particular cargo protein domain incorporates into a membrane likely will depend on the nature of the particular cargo protein domain. For example, a substantial portion of a cargo protein domain that includes integral membrane protein sequences may be incorporated into a membrane (such as, about 50%, about 60%, about 75%, about 90% or more of the cargo protein domain). A cargo protein domain that is an integral membrane protein typically will include at least one (often, two, three, four, six or more) transmembrane domains. Generally, at least one (or all) of such transmembrane domains will be incorporated within a membrane. In still other examples, all or part of the Mistic domain is incorporated into a membrane and its associated cargo protein domain is not substantially incorporated into the membrane (as may be expected, for example, for a soluble cargo protein domain). In these examples, the cargo protein domain is tethered to the membrane by its association with the membrane-bound Mistic domain and, unless the Mistic and cargo protein domains are cleaved from one another, both domains will fractionate with the membrane. In some embodiments, a cargo protein domain substantially maintains its native configuration either in solution or within a membrane, as applicable.

Membrane incorporation of all or part of a recombinant Mistic fusion protein can be determined, for example, by isolating a membrane fraction from the expression system using commonly known methods (including those described in the Examples herein), and identifying the proteins contained in the membrane fraction (for example, by gel electrophoresis or other known methods). A membrane-associated fusion protein will migrate with the membrane fraction with which it associates.

A Mistic domain includes, for example, an amino acid sequence of any Mistic polypeptide (or functional fragment or variant) described herein. In some embodiments, a Mistic domain autonomously associates with a membrane and, thereby, results in a cargo protein domain fused to the Mistic domain also becoming associated with the membrane. A cargo protein domain can be any polypeptide that can be included in a recombinant fusion protein that also contains a Mistic domain. Some method embodiments envision cargo protein domains that are all or part of an integral membrane or a soluble protein. Particular embodiments conceive a cargo protein domain as all or part of an integral membrane protein, such as a potassium channel, a G-protein linked receptor protein, a TGF-β family receptor protein. Specific examples of such integral membrane proteins are provide throughout this specification.

Integral membrane proteins had been thought to be difficult (often impossible) to successfully express in heterologous expression systems (for review, Tate, *FEBS Lett.*, 504:94-98, 2001). As disclosed herein, a recombinant fusion protein including a Mistic domain and an integral membrane protein domain is reproducibly found within the membrane of a heterologous expression system (such as, *E. coli*). In particular examples, the disclosed methods may yield no less than about 1 mg/L cells (such as no less than about 0.5, about 0.25, or about 0.1 mg/L cells) of isolated cargo protein domain or isolated recombinant fusion protein. In some cases, an amount of a cargo protein domain (which is functional and/or expressed in a substantially native configuration) that is expressed as a domain of a recombinant Mistic fusion protein is at least 10×, 25×, 50×, 100×, 250×, 500× greater than the amount of a cargo protein domain expressed alone (e.g., without a Mistic fusion partner) in a comparable (e.g., control) expression system.

Certain disclosed methods are useful for isolating a recombinant fusion protein containing a Mistic domain and a cargo protein domain, or for isolating either a Mistic domain or a cargo protein domain of such recombinant fusion protein. In these methods, a recombinant Mistic fusion protein is expressed in an expression system as described above, a membrane fraction from the expression system is isolated, and a recombinant Mistic fusion protein or its Mistic domain or cargo protein domain(s) is isolated from the isolated membrane fraction. In particular examples, a recombinant Mistic fusion protein is expressed in a cell (such as, a bacterium, like *E. coli*) and the membrane is a cell membrane. In other examples, a recombinant Mistic fusion protein is expressed in a cell-free system and the membrane or membrane-like structure are, for example, micelles, liposomes, or lipid rafts, which are included in the cell-free expression system. A cell membrane fraction can include a plasma membrane, or any intracellular membrane into which a recombinant Mistic fusion protein can be incorporated.

Any technique for isolating membrane fractions may be used in the disclosed methods. Such techniques are well known in the art (e.g., *Current Protocols in Cell Biology*, New York: John Wiley and Sons, 2001, Chapter 3), and representative techniques are provided in the Examples herein. Typically a membrane fraction can be separated from soluble materials by centrifugation because the membranes are generally heavier than the soluble materials. For example, crude plasma membranes can be prepared by suspending cells in a saline buffer (such as, 10 mM HEPES, 10 mM NaCl, 1 mM KCl, 5 mM NaHCO$_3$, 1 mM CaCl$_2$, 0.5 mM MgCl$_2$, 1 mM phenylmethylsulfonyl fluoride (PMSF), 100 U/mL aprotinin, and 5 mM EDTA) and disrupting the cells in a cell homogenizer (such as, a Dounce homogenizer). Gentle centrifugation of the homogenate (for example, at 1000×g) will pellet nuclei and intact cells, and crude plasma membranes will remain in a first supernatant. Subsequent centrifugation of the first supernatant at higher g-force (for example, at 15,000×g) will purify the plasma membranes (in the pellet) from soluble materials.

By virtue of its association with a membrane, a recombinant Mistic fusion protein will migrate with a membrane fraction. Consequently, all or part of a recombinant Mistic fusion protein (such as, a cargo protein domain or a Mistic domain) can be isolated from a membrane fraction. Isolation of all or part of a recombinant Mistic fusion protein from a membrane fraction can be accomplished using any method known to those of skill in the art. For example, immunopurification can be used. In particular examples, a recombinant Mistic fusion protein includes a tag (such as an epitope tag or a multimer-His tag) that can be recognized by a binding agent specific for the tag (such as an antibody or a nickel-containing column). By immobilizing the specific binding agent (for example, on beads or in a column), the tagged recombinant Mistic fusion protein (or a tagged portion of the fusion protein) can be captured and removed from non-bound materials. In some examples, a cleavable site (such as, a protease-sensitive site) is engineered into the recombinant Mistic fusion protein in a manner that permits a cargo protein domain to be cleaved from an isolated recombinant Mistic fusion protein. In particular examples, a tagged portion of a recombinant Mistic fusion protein (such as, a cargo protein domain) is cleaved from the fusion protein and isolated, for example, by immunopurification. In another particular example, a tethered cargo protein domain is fractionated with a membrane by virtue of its association with a membrane-bound Mistic domain, and is thereby separated from other expression system components (such as, soluble cellular components); thereafter, a tethered cargo protein domain can be cleaved from its Mistic domain fusion partner, for example, to isolate the cargo protein domain.

The following examples are provided to illustrate certain particular features and/or embodiments. These examples should not be construed to limit the invention to the particular features or embodiments described.

EXAMPLES

Example 1

Isolation of Mistic-L, a Self-Integrating Integral Membrane Protein

This example describes the isolation of a Mistic-L-encoding nucleic acid sequence and the expression of the corresponding protein. Characterization of the Mistic-L primary sequence and its oligomerization state in the presence of detergent are also described. The provision of this and other Mistic polypeptide-encoding nucleic acids, at least, enables the construction of Mistic polypeptide-encoding nucleic acid and Mistic polypeptide variants using standard molecular techniques and the expression of Mistic polypeptides and their variants in a variety of host cells, as is now common practice. The example further emphasizes the unique properties of a representative Mistic polypeptide and the clear association of members of this class of polypeptides with membranes and membrane-like structures (such as micelles or liposomes).

A. Isolation of Mistic-L-Encoding Nucleic Acid Sequence

A nucleic acid sequence encoding a 110 amino acid (13 kDa) protein (FIG. 1A) was cloned by PCR from *Bacillus subtilis* (strain 168) genomic DNA. The primers used for PCR were:

```
(forward)
                                   (SEQ ID NO: 179)
5'-TCAGGGCCATGGCATGTTTTGTACATTTTTG-3'

(reverse)
                                   (SEQ ID NO: 180)
5'-TCAGGAATTCAGCTTGATTCCGTT-3'
```

PCR was conducted with VENT thermostable polymerase for 30 cycles between 94° C. (1 minute), 50° C. (1 minute), and 72° C. (2 minutes). This amplification produced a single, ~1200 bp band, containing Mistic-L and a portion of a downstream K+ channel gene. This product was purified and digested with the restriction enzymes NcoI and EcoRI, then ligated using T4 ligase into an octa-histidine modified pET-28a plasmid (Novagen) that had been similarly digested. The ligation mixture was used to transform competent Nova Blue cells in accordance with the provided instructions (Stratagene). Cells were plated on kanamycin-laced agar and incubated overnight at 37° C. Individual colonies were cultured in 5 ml volumes of Terrific Broth and plasmid DNA was prepared using a Qiagen miniprep kit and provided instructions. Successful construction of the vector was verified by in-house DNA sequencing. Exemplary Mistic-L nucleic acid and amino acid sequences are provided in SEQ ID NOs: 1 and 2, respectively.

The fully sequenced *B. subtilis* (subspecies *subtilis*, strain 168) genome is known (see, for example, GenBank Accession No. NC 000964.2 (GI:50812173). The Mistic-L nucleotide sequence provide herein is not recognized in the *B. subtilis* genome as a protein coding gene. Instead, a Mistic-L-like nucleotide sequence is shown to a portion of the larger YugO gene open reading frame (see, for example, GenBank Accession Nos. NP 391010.2 (GI:50812283) and Z93936.1 (GI:1934801)). Derst and Karschin (*J. Exp. Biol.,* 201:2791-2799, 1998) report that the YugO nucleotide sequence (GenBank Accession No. Z93936.1 (GI:1934801)) contained a sequence encoding a K+ channel (referred to as YugO-b) and a "putative N-terminal domain" (referred to as YugO-a).

However, neither the nucleotide nor amino acid sequences of the putative N-terminal domain were specifically identified. Thus, until now, a Mistic-L-encoding nucleic acid sequence and its corresponding protein have not been known as separate and independent biological compounds.

As shown in FIG. 1A, Mistic-L nucleic acid sequence encodes a highly hydrophilic protein. Only 33% of the Mistic-L amino acid residues are hydrophobic and all such residues are spatially dispersed throughout the sequence. Mistic-L protein lacks any known signal sequences, such as a membrane-targeting sequence. The provision herein of the Mistic-L-encoding nucleic acid sequence enables, for example, the isolation of homologs from other species (see, e.g., Example 10).

B. Expression and Isolation of Recombinant His-Tagged Mistic-L

Mistic-L and certain of its variants were expressed in bacteria using methods common in the art. Briefly, Mistic-L-encoding nucleic acids (such as, sequences encoding Mistic-L, its variants, and Mistic-L fusion proteins) were introduced into octa-histidine-tag modified pET-28a (Novagen) for expression of His-tagged Mistic-L proteins in bacterial host cells. Freshly transformed colonies were cultured in TB and induced with 0.1 mM isopropyl-β-D-thiogalactopyranoside (IPTG) at an O.D. of 1.0. Growth was continued overnight at 10-18° C. Cells were harvested and resuspended in 50 mM Tris pH 8.0, 300 mM KCl, 10% glycerol, 10 mM imidazole with 1 mg/ml lysozyme. Cells were disrupted by sonication on ice and membranes were pelleted by high speed centrifugation. Membranes were solubilized by sonication in the above buffer with the addition of 20 mM LDAO. Insoluble material was removed by high speed centrifugation and the desired protein was purified from the resulting supernatant using Ni-NTA affinity chromatography (Qiagen). Further purification, when necessary, was conducted by FPLC gel filtration (Pharmacia) in 50 mM Tris pH 8.0, 300 mM KCl with 3 mM LDAO using either S200 Superdex™ (for Mistic-L) or Superose-6™ (for eukaryotic IM proteins and Mistic-L fusions thereof) (Pharmacia).

As shown in FIG. 1B, Mistic-L associated tightly with the bacterial membrane when expressed recombinantly in *E. coli*. There was no appreciable accumulation of Mistic-L protein in any other bacterial compartment, including cytoplasm or inclusion bodies, and Mistic-L was not substantially secreted by the bacteria (see FIG. 1B). The association of Mistic-L with the bacterial membrane was (and is) a surprisingly unexpected result, at least, because Mistic-L is highly hydrophilic (see FIG. 1A) and lacks a recognizable membrane-targeting sequence. These particular properties support the non-binding theory that Mistic-L may insert and fold into the membrane in a unique fashion.

C. Mistic-L Oligomerization in Detergent

To further demonstrate the unexpected interaction of Mistic-L with hydrophobic structures (such as, cell membranes), the oligomerization state of Mistic-L solubilized in lauryl-dimethylamine oxide (LDAO) was determined utilizing static light scattering in combination with detection of UV absorption.

Static light scattering analysis was conducted on the eluant from a GFC-1300 analytical HPLC column (Supelco), monitored with a three-angle scattering detector (Wyatt Mimidawn) and a photodiode array UV absorbance detector at 280 nm (Waters) according to the manufacturers' instructions. Detergent-solubilized Mistic-L bound tightly to micelles and aggregated rapidly when forcefully stripped of surfactant. The data was fitted with integral multimers of Mistic-L with the protein-detergent complex (PDC) extinction coefficient corrected for the relative percentage of non-absorbing LDAO, as provided by the manufacturers.

Only a monomeric model yielded a relatively equal mass ratio of protein to detergent, as observed for other typical PDCs, with the number of detergent molecules in the PDC (49) similar to the aggregation number for LDAO micelles (76). As shown in FIG. 1C, Mistic-L forms a PDC of approximately 25 kDa containing approximately 50 molecules of LDAO (MW=229.4) per Mistic-L (that is, a 13.4 kDa Mistic-L protein complexed with an 11.4 kDa micelle).

Gel filtration was performed using a SuperDex™ column (Amersham Biosciences) equilibrated with 300 mM KCl, 50 mM Tris (pH 8.0), and 3 mM LDAO and run at a rate of 1 ml per minute. Gel filtration sizing supported either a monomeric or dimeric complex. However, only a monomeric model was consistent with the observation that under oxidizing conditions, Mistic-L underwent a single, discreet shift in size as measured by size exclusion chromatography, presumably through intermolecular cross-linking via its only cysteine. A dimeric assembly would theoretically either not alter in apparent size (cis-oxidation) or polymerize (trans-oxidation).

Example 2

Mistic-L Mutants Reveal the Orientation of Mistic-L in the Membrane

This example demonstrates the orientation (also referred to as topology) of a representative Mistic polypeptide in a cell membrane model using a panel of mono-cysteine Mistic-L mutants. Among other things, these mutants define Mistic-L residues that can be modified without appreciable effect on Mistic-L membrane-associating function. From information provided herein, the corresponding residues of other Mistic polypeptides (e.g., M1, M2, M3 or M4) can be readily determined.

Mistic-L topology studies were conducted with a Mistic-L fusion to a bacterial 6TM potassium channel from *Pseudomonas aeruginosa* (KvPae) (GenBank Accession No. NP_250187). The KvPae channel, which was substantially identical in all constructs, served as an internal control for calibrating expression, extraction, biotinylation and detection efficiency between the samples. Mistic-L-KvPae fusion constructs were created by subcloning KvPae from a sequencing cosmid containing the gene into a pET-15b vector (Novagen) containing an N-terminal octa-His tag and Mistic-L sequence. Each Mistic-L-KvPae fusion protein contained a thrombin site between the two protein domains to facilitate cleavage of Mistic-L from KvPae as appropriate.

Four mono-cysteine Mistic-L mutants were engineered. In addition to the single natural occurring (wild-type) cysteine (residue 3), cysteine mutations were introduced individually at the C-terminus (residue 110) and in predicted loop regions at positions 30, 58, and 88 (FIG. 1A). In these cysteine variants, the naturally occurring cysteine was mutated to valine. These positions were chosen using NMR-derived knowledge of the secondary structural element boundaries of Mistic-L (see Example 3). All mutagenesis was conducted using Quickchange™ (Stratagene) in conformance with manufacturer's instructions.

Mistic-L-KvPae fusion proteins were expressed in *E. coli* as described in Example 1. Approximately 10 hours after induction of fusion protein expression, right-side-out (RSO) vesicles were prepared as described by Kaback (*Methods Enzymol.*, 22:99-120, 1971). Mistic-L (and KvPae) biotinylation was achieved by exposing the RSO vesicles to the membrane impermeable thiol biotinylating reagent, 3-(N- maleimido-propinyl) biocytin (MPB; Molecular Probes), as described by Ramamurthy and Oliver (*J. Biol. Chem.*, 272: 23239-23246, 1997). Subsequent to MPB labeling, vesicles were solubilized by sonication in 20 mM LDAO and His-tagged Mistic-L-KvPae fusion proteins were purified using Ni-NTA resin. Affinity purified proteins were digested with thrombin to cleave the Mistic-L and KvPae domains and were separated on SDS-PAGE gels. Streptavidin conjugated horseradish peroxidase was used to illuminate biotinylated products using standard ECL™ protocols (Amersham).

As shown in FIG. 1D, only the cysteine at position 110 of Mistic-L (in the Glu110Cys mutant) had sufficient periplasmic exposure in *E. coli* RSO vesicles to be reactive with MPB. Cysteines at positions 30, 58, and 88 (in mutants Thr30Cys, Ser58Cys, and Asn88Cys, respectively) were nonreactive with MPB, which demonstrates that these Mistic-L residues are chemically inaccessible from the exterior of RSO vesicles. This result is consistent with the residues at positions 30, 58, and 88 of Mistic-L being membrane embedded.

Regardless of which Mistic-L mutant was fused to KvPae, KvPae was consistently biotinylated in RSO vesicles (see FIG. 1D). KvPae is a transmembrane protein with Cys residues exposed in the *E. coli* periplasmic space. KvPae biotinylation in each sample indicates that no substantial differences between preparation or reaction conditions for the various samples. Moreover, because the Mistic-L and KvPae domains were fused at the time of membrane insertion, consistent KvPae biotinylation demonstrates that each of the corresponding Mistic-L fusion proteins retained membrane-associating function. Accordingly, none of the mono-cysteine Mistic-L mutations affected the membrane-associating capacity of the corresponding Mistic-L fusion protein.

Example 3

NMR Structure of Mistic-L

The ability to stably extract high yields of Mistic-L from *E. coli* membranes utilizing the detergent LDAO permitted the use of NMR for the de novo determination of Mistic-L structure. This example describes the secondary and tertiary (aka, three-dimensional or space-filling) structure of Mistic-L, as determined by NMR. The provision of the tertiary structure of Mistic-L, at least, enables rapid and relatively effortless determination of structural mutants that will or will not affect the membrane-associating function of Mistic-L or other Mistic polypeptides (such as, M1, M2, M3 and/or M4).

A. NMR Materials and Methods

Stable-isotope labeled protein was expressed utilizing established protocols (Marley et al., *J. Biomol. NMR*, 20:71-75, 2001). This procedure allowed straightforward adaptation of protein-specific expression protocols that use rich media and provided a several-fold reduction in isotope costs. Using this method, the incorporation of $^{15}N$ and $^{13}C$ was about 85% and deuteration level was about 70%. A series of [$^{15}N$, $^{1}H$]-TROSY experiments of $^{15}N$, $^{2}H$-labeled Mistic-L in presence of the detergents lyso-myristoyl-phosphotidyl-glycerol (LMPG) and LDAO were measured allowing a qualitative comparison of the extent of peak overlap and the $^{15}N/^{1}H$ linewidths of cross peaks. The results suggested that structure determination could be best facilitated in a solution of 10 mM BisTris(HCl) pH 5.4, 95% $H_2O$/5% $D_2O$, in presence of approximately 50 mM LDAO with a protein concentration of 2 mM. All NMR spectra were recorded at 37° C. on Bruker 700 MHz spectrometer equipped with four radio-frequency channels and a triple resonance cryo-probe with a shielded z-gradient coil. $^{1}H$, $^{13}C$ and $^{15}N$ backbone resonances were assigned using the TROSY-based (Pervushin et al., *Proc. Natl. Acad. Sci. USA.*, 94:12366-12371, 1997) triple resonance experiments HNCA (Grzesiek and Bax, *J. Biomol. NMR*, 9:207-211, 1997) and HNCA$^{coded}$CO (Ritter et al., *J. Biomol. NMR*, 28:289-294, 2004), and 3D $^{15}N$-resolved TROSY-[$^{1}H$, $^{1}H$]-NOESY with a mixing time of 200 ms. Partial side chain assignment was achieved with 3D H(CC-TOCSY-CO)-NH and 3D $^{15}N$-resolved TROSY-[$^{1}H$, $^{1}H$]-NOESY experiments. Aromatic side chain assignments were obtained from 3D $^{13}C^{aromatic}$ resolved [$^{1}H$, $^{1}H$]-NOESY and a high-resolution [$^{13}C$, $^{1}H$]-HMQC using the C—C splitting for spin system identification. Distance constraints for the calculation of the 3D structure were derived from 3D $^{13}C$- or $^{15}N$-resolved [$^{1}H$, $^{1}H$]-NOESY spectra recorded with a mixing time of 200 ms. Angle restraints were derived from the deviation of the $^{13}C^{\alpha}$ chemical shifts from 'random coil' chemical shifts (Luginbuhl et al., *J. Biomol. NMR*, 8:136-146, 1996; Erratum in: *J. Biomol. NMR*, 9:212, 1997). All experiments were optimized for sensitivity and set up in a water flip-back manner to enhance the longitudinal relaxation (Riek et al., *J. Am. Chem. Soc.*, 124:12144-12153, 2002). The TROSY-HNCA formed the base for the sequential backbone assignment as the most sensitive triple resonance experiment that connects sequential residues through the $^{13}C^{\alpha}$ chemical shifts. Ambiguities were resolved with the TROSY-HNCA$^{coded}$CO, which has a two-fold increased resolution along the $^{13}C$ frequency and contains correlations via the chemical shifts of both $^{13}C^{\alpha}$ and $^{13}C^{\gamma}$, advantages that compensate for a lower overall sensitivity as compared with the TROSY-HNCA. The TROSY-based $^{15}N$-resolved [$^{1}H$, $^{1}H$]-NOESY was also used to resolve ambiguities in the assignment process by the collection of sequential amide-amide NOEs. Hence, the backbone assignment was established through three independent correlations, the $^{13}C^{\alpha}$ chemical shifts, the $^{13}C^{\gamma}$ chemical shifts and the $^{1}H_{N}$-$^{1}H_{N}$ NOEs. Hydrophobicity-selective paramagnetic perturbation was conducted utilizing Gd$^{3+}$ DOTA-Amp and 16-doxyl-stearic acid (Hilty et al., *Chembiochem.*, 5:467-473, 2004). Spectra were analyzed utilizing CARA with XEASY, $^{13}C^{\alpha}$ chemical shift deviations were measured with MAPPER (Guntert et al., *J. Biomol. NMR*, 18:129-137, 2000), and restraint models were built and assessed with CYANA (Guntert, *Methods Mol. Biol.*, 278:353-378, 2004). Structural figures were made using either MOLSCRIPT (Esnouf, *Acta Crystallogr. D. Biol. Crystallogr.*, 55:938-940, 1999) or MOLMOL (Koradi et al., *J. Mol. Graph.*, 14:29-32, 1996).

B. NMR Determination of Mistic-L Secondary and Tertiary Structure

For the sequential backbone assignment, the TROSY-HNCA (Pervushin et al., *Proc. Natl. Acad. Sci. USA.*, 94:12366-12371, 1997; Salzmann et al., *J. Biomol. NMR*, 15:181-184, 1999); TROSY-HNCA$^{coded}$CO (Ritter et al., *J. Biomol. NMR*, 28:289-294, 2004) and the TROSY-based $^{15}N$-resolved [$^{1}H$, $^{1}H$]-NOESY (mixing time 200 ms) of a $^{2}H$, $^{15}N$, $^{13}C$-labeled sample was measured. The $^{13}C^{\alpha}$ chemical shift deviation from 'random coil' values, the observed NOE pattern, and slow $^{1}H_{N}$ exchange with solvent strongly indicates the presence of four helices comprising residues 8-22, 32-55, 67-81, and 89-102 (see FIG. 2A).

While intra-residue, sequential and medium range NOEs and angle restraints enabled the assignment of secondary structure, long range restraints are needed to determine the fold of the protein. Since a lack of unambiguous long range NOEs is common in α-helical, $^{2}H$, $^{15}N$, $^{13}C$-labeled membrane proteins, alternative tactics for collecting long range restraints were employed. The mono-cysteine mutant library described in Example 2 was used to incorporate site-directed spin-labels that perturb the NMR spectra in order to derive long-range distance restraints. It has long been recognized that distance-dependent line broadening of nuclear magnetic resonances can be observed in protein samples containing paramagnetic electrons (Kosen, *Methods Enzymol.*, 177:86-121, 1989). However, only recently has the observed line broadening effect been translated into distances for structure determination (Battiste and Wagner, *Biochemistry*, 39:5355-5365, 2000).

[$^{15}$N, $^1$H]-TROSY experiments were measured on Mistic-L samples modified with the thiol-reactive nitroxide label, (1-oxyl-2,2,5,5-tetramethyl-$\Delta^3$-pyrroline-3-methyl)methanethiosulfonate (MTSL) (see FIG. 2B). Paramagnetic labeling with MTSL was done in accordance with established protocols (Battiste and Wagner, *Biochemistry*, 39:5355-5365, 2000). Corresponding reference experiments were measured by quenching the nitroxide label with ascorbic acid, followed by additional reference experiments after removal of the quenched nitroxide label with reducing agents. The signal changes observed for the five spin-labeled samples were transformed into 197 long range upper distance and 290 lower distance restraints (see FIG. 2C).

Figure 2A:
FIG. 2A, first line shows $^1H_N$ protection from solvent exchange indicative for hydrogen bond formation (stars). The solvent protection is determined by the absence of a cross-peak between the chemical shifts of $^1H_N$ and water in the $^{15}$N-resolved TROSY-[$^1$H, $^1$H]-NOESY spectrum.

Initial structure calculation was performed with CYANA (Guntert, *Methods Mol. Biol.*, 278:353-378, 2004) using the collected NOE data, chemical shift-derived angle restraints, and restraints derived from spin-labeling. In addition, α-helical hydrogen bond restraints were implemented for residues that show all of the three following properties: slow HN exchange, a helical $^{13}$C chemical shift, and helical backbone NOEs (FIG. 2A). In an iterative process, the derived scaffold was used to collect long-range and medium range NOEs and to refine calibration of the spin-label restraints. Several rounds of structure calculation and collection of restraints were performed. The 29 collected long-range NOEs are of the type methyl/aromatic protons to amide protons. Since these distances are intrinsically large in a helical bundle and concomitantly result in weak NOEs, the use of a cryoprobe and long mixing times of 200 ms were used.

The final structure calculation was performed with 573 NOE distance restraints, 346 angle restraints from chemical shifts and NOE's, and 478 distance restraints from the spin-label experiments, as shown more particularly in the following Table 2.

TABLE 2

NMR Structure Statistics

| Restraints | | |
|---|---|---|
| Hydrogen bonds | | 43 |
| NOE distances | intraresidue | 127 |
| | short range | 248 |
| | medium range | 169 |
| | long range | 29 |
| Dihedral angles | | 346 |
| Spin label restraints | long range, upper distance | 197 |
| | long range, lower distance | 290 |
| Residual upper limit constraint violations (including spin label restraints) | | |
| Number > 0.5 Å | | 3 |
| Maximum | | 0.7 Å +/− 0.1 |
| Residual dihedral angle constraint violations | | |
| Number > 5.0° | | 2 |
| Maximum | | 6.7° +/− 4 |

TABLE 2-continued

NMR Structure Statistics

| Backbone RMSD. | |
|---|---|
| Residues 11-105 | 1.4 |
| Residues 13-52, 67-102 | 1.0 |
| Heavy Atom RMSD | |
| Residues 11-105 | 2.0 |
| Residues 13-52, 67-102 | 1.6 |
| Ramachandran Plot | |
| Residues in most favored regions | 64.4% |
| Residues in allowed regions | 31.8% |

A total of 100 conformers were initially generated by CYANA and the bundle of 10 conformers with the lowest target function was used to represent the three-dimensional NMR structure (see FIG. 3A). The small residual constraint violations in the 10 refined conformers and the good coincidence of experimental NOEs show that the input data represent a self-consistent set and that the restraints are well satisfied in the calculated conformers. The deviations from ideal geometry were minimal, and similar energy values were obtained for all 10 conformers (Table 2). The high quality of the structure was also reflected by the small (approximately 1.0 Å) backbone RMSD values relative to the mean coordinates for residues 13-52, 67-102.

The resulting structure is a four-helical bundle with many highly unusual features for an IM protein (FIG. 3B, E). For example, all but the second helix (α2) are shorter (approximately 14 amino acids) than expected for a typical bilayer-traversing helix. This may be due to partial unraveling of the ends of the helices in the detergent micelle environment. Additionally, α2 possesses a significant kink, centrally positioned and putatively within the membrane. Also surprisingly, while assembled internally with a typical hydrophobic core and compensating polar interactions towards its surface (FIG. 3D), Mistic-L retains an unexpectedly hydrophilic surface for an IM protein (FIG. 3C, F) (Berman et al., *Nucleic Acids Research*, 28:235-242, 2000). The atomic coordinates for Mistic-L structure are listed in Table 4 (preceding the claims), and have been deposited as PDB Identification No. 1YGM (release date Mar. 1, 2005).

C. Interaction Between Mistic-L and Hydrophobic Lipid Bilayer

Given the membrane-transversing topology demonstrated by MPB labeling (see Example 1 and FIG. 1D), the hydrophilic surface of Mistic-L was surprisingly unexpected. To confirm the orientation of Mistic-L with respect to the membrane and to understand the chemical nature of Mistic-L's interaction with a hydrophobic lipid bilayer, NOEs between Mistic-L and its solubilizing LDAO detergent micelle were measured and assigned.

Figure 4:
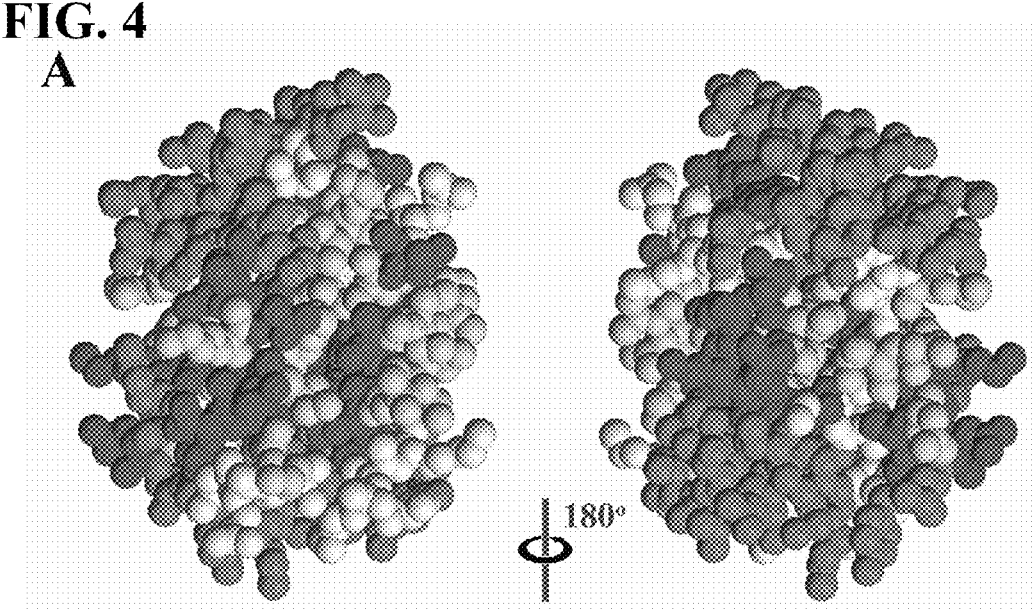
FIG. 4 shows four panels describing Mistic-L-detergent interactions.
Figure 4:
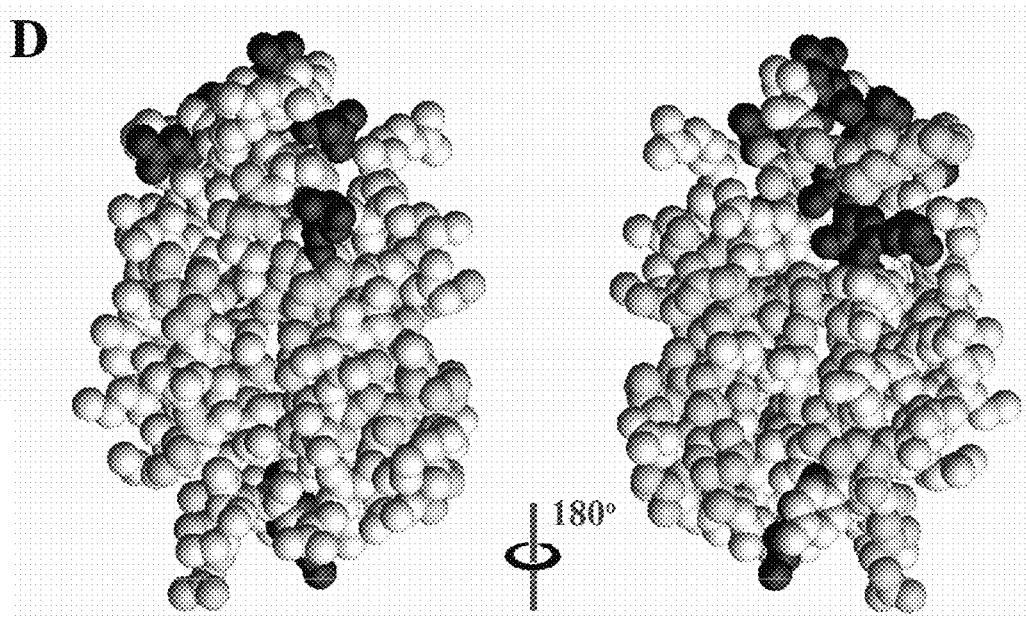

When mapped to the surface of the Mistic-L structure, as expected for a membrane-integrated protein, a concentric ring of detergent interactions around the helical bundle was observed (FIG. 4A-C). Additionally, Mistic-L spectra was perturbed with paramagnetic probes that selectively partition to hydrophilic or hydrophobic environments as described by Hilty et al. (*Chembiochem.*, 5:467-473, 2004). Results from this study (shown in FIG. 4D) also correlate well with the aforementioned detergent belt around Mistic-L and confirm that Mistic-L was embedded within the LDAO micelle.

This example demonstrates that Mistic-L is a hydrophilic protein that nevertheless traverses the hydrophobic environments of micelles cores and lipid bilayers.

Example 4

Proteins Fused to Mistic-L are Targeted to the Membrane

This example demonstrates that Mistic-L targets (i.e., cargoes or traffics) a variety of other proteins to which it is fused to a cell membrane. When fused to Mistic-L's C-terminus, a fusion partner protein (also referred to as a "cargo protein") readily folds into its native, lipid bilayer-inserted conformation, apparently (though not necessarily) bypassing *E. coli* translocon and chaperone apparatus. Accordingly, Mistic-L fusion proteins provide, among other things, useful methods of producing and isolating Mistic-L fusion partners.

Mistic-L was subcloned along with the promoter and affinity tag into pET-15b (Novagen) (see, e.g., Examples 1 and 2) or Gateway™ destination (Invitrogen) vectors (in accordance with manufacturer's directions) for expression studies of Mistic-L-eukaryotic IM protein fusions. Mistic-L-assisted expression was determined for three topologically and structurally distinct classes of eukaryotic IM proteins: voltage-gated $K^+$ channels, receptor serine kinases of the TGF-β superfamily, and G-protein coupled receptors (each shown schematically in FIG. 5A). Eukaryotic target genes were cloned by PCR and fused downstream of Mistic-L with a separation linker of 5-35 amino acids. The full length genes of cargo proteins (6 Kv channels, 9 GPCRs, 7 TGF-β receptors; see Table 3) were used, except that signal sequences were omitted and for Kv channels, flexible N-terminal 'ball & chain' motifs were also omitted. Representative Mistic-L fusion protein constructs are shown in Table 1 (together with sequence identifiers for the respective amino acid and nucleic acid sequences).

TABLE 3

Fusion Partner Proteins

| Gene Name | Gene Length | Protein MW (kDa) | Membrane Expression | Ligand | Binding Assay | Full Name[a] |
|---|---|---|---|---|---|---|
| *Potassium Channels* | | | | | | |
| aKv1.1 | 1380 | 52 | + | | | Aplysia Kv1.1 channel (NT 391-1743 of SEQ ID NO: 89) (AA 131-581 of SEQ ID NO: 90) |
| rKv1.2 | 1404 | 53 | + | dendrotoxin | | Rat Kv1.2 channel (NT 436-1836 of SEQ ID NO: 103) (AA 146-612 of SEQ ID NO: 104) |
| hKv1.5 | 1485 | 56 | + | | | human Kv1.5 channel (NT 436-1917 of SEQ ID NO: 97) (AA 146-639 of SEQ ID NO: 98) |
| rKv2.1 | 2484 | 92 | + | | | Rat Kv2.1 channel (NT 436-2916 of SEQ ID NO: 99) (AA 146-972 of SEQ ID NO: 100) |
| rKv3.1 | 1758 | 66 | + | | | Rat Kv3.1 channel (NT 436-2190 of SEQ ID NO: 101) (AA 146-730 of SEQ ID NO: 102) |
| rKv4.2 | 1773 | 51 | − | | | Rat Kv4.2 channel (NT SEQ ID NO: 184) (AA SEQ ID NO: 185) |
| *Receptor Serine Kinases of the TGF-β Superfamily* | | | | | | |
| Alk2 | 1461 | 55 | + | Activin | | Activin type Ia receptor (NT 493-2260 of SEQ ID NO: 115) (AA 165-655 of SEQ ID NO: 116) |
| Alk3 | 1527 | 58 | + | BMP2/7 | + | BMP type 1a receptor (NT 493-2326 of SEQ ID NO: 119) (AA 165-677 of SEQ ID NO: 120) |
| Alk5 | 1407 | 53 | + | TGF-beta | | TGB-beta type I receptor (NT 493-2206 of SEQ ID NO: 123) (AA 165-637 of SEQ ID NO: 124) |
| Alk6 | 1467 | 56 | + | BMP2/7 | | BMP type Ib receptor (NT 493-2266 of SEQ ID NO: 127) (AA 165-657 of SEQ ID NO: 128) |
| ActRII | 1482 | 56 | + | Activin | | Activin type II receptor (NT 493-2281 of SEQ ID NO: 131) (AA 165-662 of SEQ ID NO: 132) |
| ActRIIb | 1545 | 59 | + | Activin | − | Activin type IIb receptor (NT 493-2344 of SEQ ID NO: 135) (AA 165-683 of SEQ ID NO: 136) |
| BMPRII | 1512 | 57 | + | BMP2/7 | + | BMP type II receptor (NT 493-2311 of SEQ ID NO: 139) (AA 165-672 of SEQ ID NO: 140) |
| *G-protein Coupled Receptors* | | | | | | |
| CRFR1 | 1176 | 46 | + | Astressin | + | CRF receptor 1 (NT 493-1975 of SEQ ID NO: 143) (AA 165-560 of SEQ ID NO: 144) |
| CRFR2β | 1215 | 48 | + | Astressin | + | CRF receptor 2 beta (NT 493-2014 of SEQ ID NO: 147) (AA 165-573 of SEQ ID NO: 148) |

TABLE 3-continued

Fusion Partner Proteins

| Gene Name | Gene Length | Protein MW (kDa) | Membrane Expression | Ligand | Binding Assay | Full Name[a] |
|---|---|---|---|---|---|---|
| CD97 | 2166 | 80 | + | CD55 | | CD97 antigen<br>(NT 493-2661 of SEQ ID NO: 151)<br>(AA 165-886 of SEQ ID NO: 152) |
| CCR5 | 1056 | 41 | + | CC3 | | Chemokine (C-C motif) receptor 5<br>(NT 493-1855 of SEQ ID NO: 155)<br>(AA 165-520 of SEQ ID NO: 156) |
| RAI3 | 1071 | 40 | + | | | Retinoic acid induced 3<br>(NT 493-1566 of SEQ ID NO: 159)<br>(AA 165-521 of SEQ ID NO: 160) |
| GPRC5B | 1125 | 42 | + | | | G protein-coupled receptor, family C,<br>grp 5, mbr B<br>(NT 493-1620 of SEQ ID NO: 163)<br>(AA 165-539 of SEQ ID NO: 164) |
| ETL | 2013 | 76 | − | | | EGF-TM7-latrophilin-related protein<br>(NT 493-2508 of SEQ ID NO: 167)<br>(AA 165-835 of SEQ ID NO: 168) |
| GABABR1 | 2445 | 92 | − | GABA | | Gamma-aminobutyric acid B<br>receptor, 1<br>(NT 493-2940 of SEQ ID NO: 171)<br>(AA 165-979 of SEQ ID NO: 172) |
| VIPR2 | 1254 | 48 | − | VIP | | Vasoactive intestinal peptide<br>receptor 2<br>(NT 493-1749 of SEQ ID NO: 175)<br>(AA 165-582 of SEQ ID NO: 176) |

[a]Proteins of human origin unless otherwise noted.
NT = nucleotide
AA = amino acid Eighteen of twenty-two Mistic-L fusion constructs expressed in E. coli (as described in Example 1) were localized to the cell membrane (see Table 3). As known to those of ordinary skill in the art, expression levels were influenced by induction conditions and proteolytic susceptibility of the expressed protein (in particular, the cargo protein domain and the linker between the Mistic-L and cargo protein domains). Nonetheless, following thrombin-mediated cleavage from Mistic-L, yields of cargo proteins from the membrane fractions of recombinant bacteria often exceeded 1 mg per liter of culture (see for example, FIG. 5B). Such consistent, high-yield, heterologous production of structurally distinct eukaryotic IM proteins in E. coli is unprecedented (for review see Tate, FEBS Lett., 504:94-98, 2001).

For those Mistic-L fusion constructs that were not localized to the cell membrane (see Table 3), the expression of Mistic-L with no fusion partner domain (or very truncated snippets of the fusion partner domain) was observed. This result indicates that the cargo protein was likely separated from its Mistic-L domain, for example by endogenous proteases, before Mistic-L could traffic the cargo protein to the membrane. Accordingly, it is believed that such Mistic-L fusion constructs may be successfully produced in protease-deficient bacteria or under other circumstances that limit proteolysis of the Mistic-L fusion protein. Some eukaryotic proteins are thought to require post-translational modification to fold into their correct conformation. Such post-translational modifications do not naturally occur within a typical bacterial host cell and proteins requiring such modifications for proper folding are preferably avoided in those method embodiments involving bacterial expression.

Figure 5:
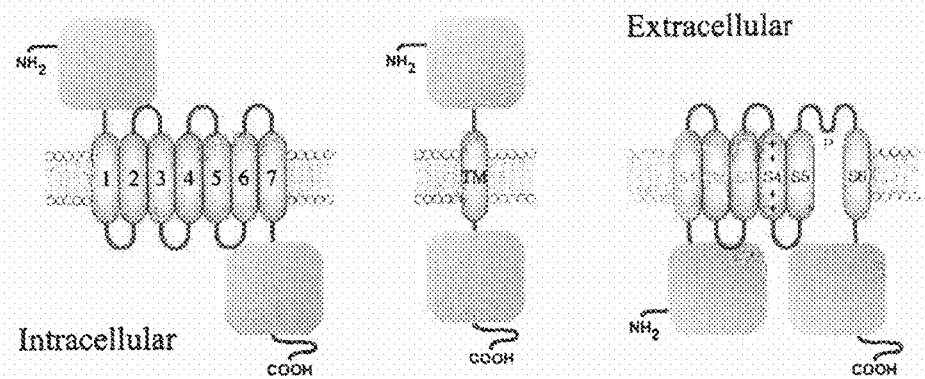
FIG. 5 shows two panels relating to Mistic-L-assisted eukaryotic IM protein expression.
Figure 5:
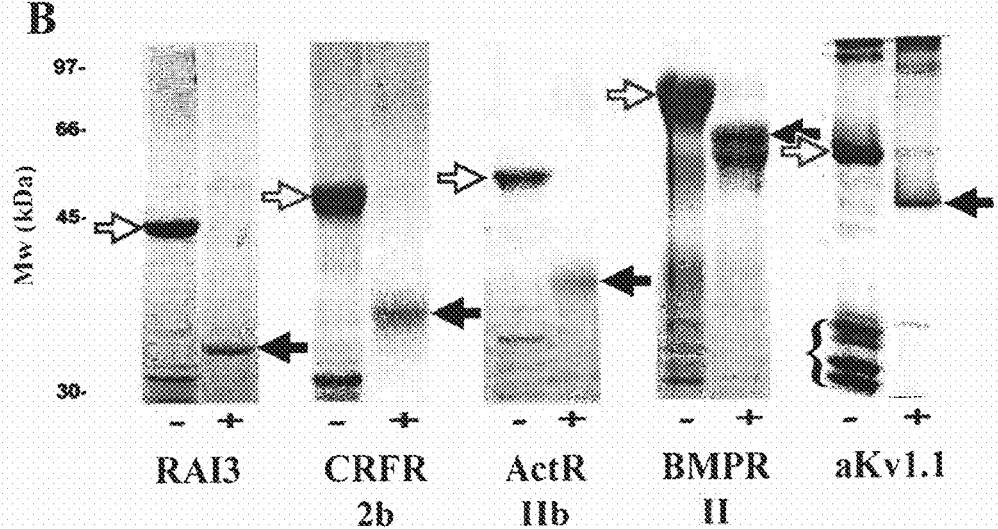

FIG. 5 B demonstrates the high-yield expression of several representative Mistic-L fusion constructs. Proteins in LDAO-solubilized membrane fractions were purified by Ni-NTA affinity chromatography. The indicated Mistic-L-fused protein (RAI3, CRFR2b, ActR IIb, BMPR II or aKv1.1) is shown by the open arrow in the respective lanes marked "−". A portion of each affinity-purified fusion protein was digested with thrombin to yield an isolated cargo (i.e., fusion partner) protein. In FIG. 5B, isolated RAI3, CRFR 2b, ActR IIb, BMPR II or aKv1.1 are shown by the solid arrows in the respective lanes marked "+". N-terminal Edman degradation sequencing of at least 14 residues of the cargo protein after separation from Mistic-L was performed for select samples (including RAI3, BMPR II and aKv1.1) to confirm protein identity. Additional bands in the pre-digestion sample of aKv1.1 (FIG. 5B, aKv1.1, bracket) were determined to be truncated products containing fragments of the N-terminal domain (T1) of this channel. The region between T1 and the membrane-spanning domain of this channel is known to be flexible and proteolytically susceptible (Kobertz et al., Biochem., 39(34), 10347-10352, 2000).

Figure 6:
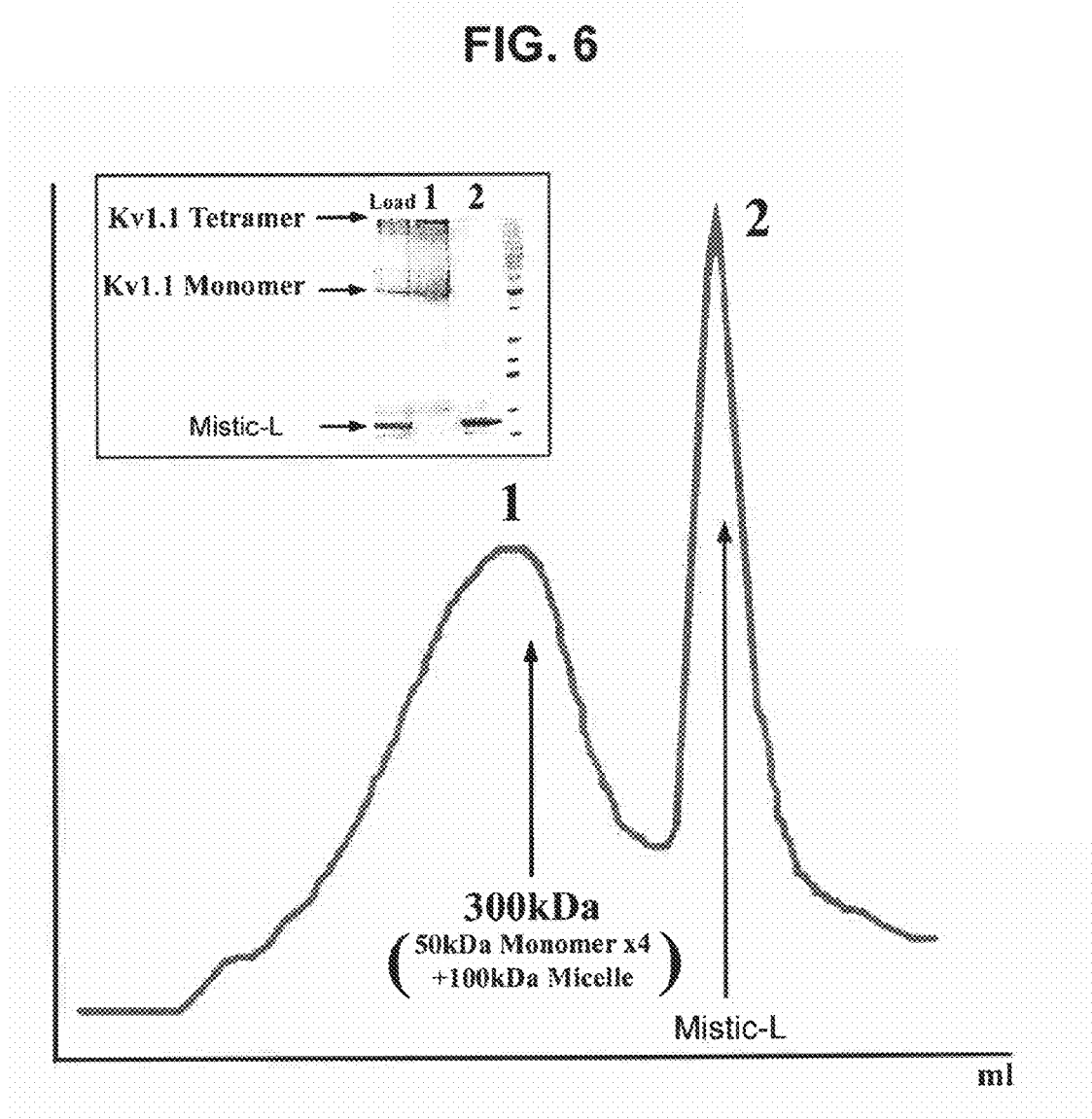
FIG. 6 is a gel filtration profile of thrombin digested aKv1.1 run in 3 mM LDAO on a Superose-6 column. aKv1.1 elutes as a detergent solubilized tetramer subsequent to Mistic-L removal. The inset shows that baseline separation between aKv1.1 (peak 1; lane 1) and Mistic-L (peak 2; lane 2) allows two-step purification of aKv1.1 to near homogeneity.

Recombinant proteins produced by fusion to Mistic-L retained their native conformations and functions. For example, aKv1.1 was cleaved from a Mistic-L-aKv1.1 fusion protein using thrombin, solubilized in 3 mM LDAO, and purified by size exclusion chromatography on a Superose-6 column. As shown in FIG. 6, aKv1.1 eluted from the column (peak 1) was an expected 300 kDa tetrameric assembly (i.e., four 50 kDa monomers plus 100 kDa micelle). As shown in the FIG. 6 inset, aKv1.1 and Mistic-L present in a single sample (lane entitled "load") were substantially separated by size exclusion chromatography (compare Kv1.1 monomer in lane 1 and Mistic-L in lane 2 with "load" lane). Thus, aKv1.1 (and other Mistic-L cargo proteins) were (and can be) purified to near homogeneity using a simple two-step purification as described herein.

Several of the cargo proteins described in this Example specifically bind known ligands. Selected ligand-binding cargo proteins were purified from their respective Mistic-L fusion proteins as described in this Example. As shown in Table 3, at least, Alk3, BMPRII, CRFR1, and CRFR2β retained their native ligand-binding affinity and specificity.

Figure 11:
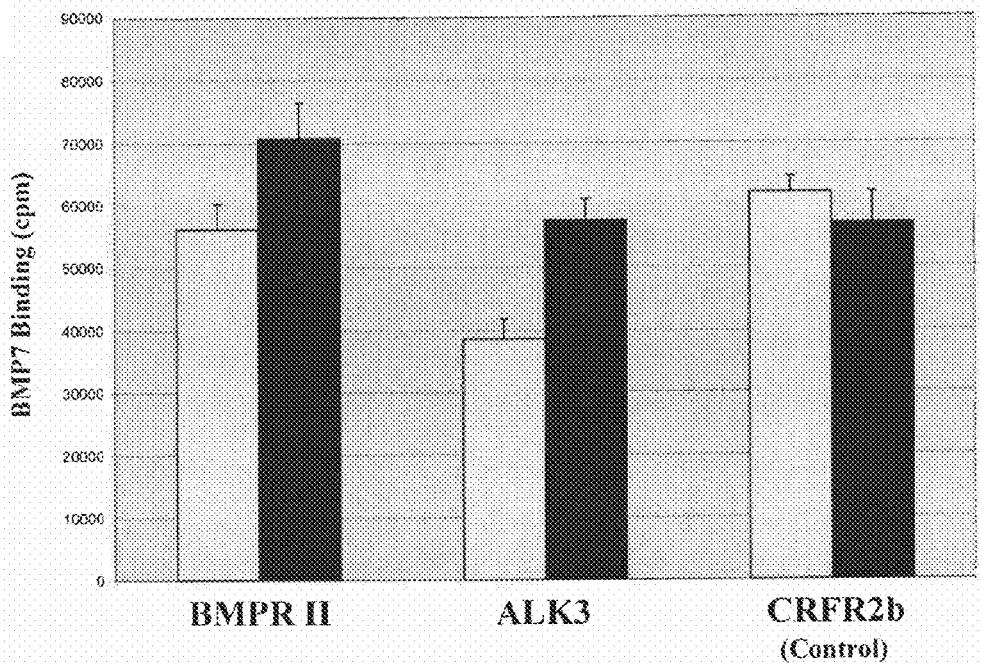
FIG. 11 is a graph of $^{125}$I-BMP7 ligand binding for the indicated receptors in the absence (black bars) or presence (grey bars) of unlabeled BMP7.

In a particular example, BMPRII, ALK3 and CRFR2β were incubated with 5×10⁵ cpm $^{125}$I-BMP7 tracer in the presence or absence of 40 nM unlabeled BMP7 as competitor. BMPRII and ALK3 are type II and type I receptors of BMP7, respectively. CRFR2β is a G-protein coupled receptor with no known affinity for BMP7 and was included as a control. Samples were prepared in triplicate in 1.7 ml eppendorf tubes in a final volume of 1 ml binding buffer (150 mM NaCl, 50 mM Tris (pH 7.5), 0.1% BSA). Binding was performed for 150 minutes at room temperature. After an initial 60 minutes of binding, 20 μl of 50% Ni-NTA resin (Qiagen) was added to each sample and allowed to bind for the balance of the 90 minute incubation period. Complexes were precipitated by centrifugation and washed three times in 1 ml binding buffer. After the final wash, bound $^{125}$I-BMP7 tracer was quantified in a gamma counter. BMP7 was iodinated using a modified Cloramine-T procedure (see, e.g., Lawler et al., *J. Neurosci. Meth.*, 49:141-53, 1993). As shown in FIG. 11, unlabeled BMP7 competitively inhibited $^{125}$I-BMP7 binding to BMPRII and ALK3, but had no significant effect on the amount of signal measured in the CRFR2β sample.

This and the foregoing examples demonstrate that Mistic-L functions to assist in the heterologous expression of a wide variety of IM proteins while displaying no specific affinity for any protein once proteolytically cleaved from its cargo. Structural and functional data from cleaved cargo proteins further demonstrate that Mistic-L fusions can be used to produce IM proteins fully folded and in their native conformations. Mistic-L lacks any lengthy spans of hydrophobic residues or any motif resembling a signal sequence, and yet is fully membrane integrated with a periplasmically exposed C-terminus. All of these unusual characteristics suggest that Mistic-L, in particular, and Mistic polypeptides, in general, may autonomously associate with bacterial membranes.

In one non-binding, proposed mechanism (see FIG. 15, Schematic I), a Mistic polypeptide (e.g., Mistic-L, M1, M2, M3 or M4) is produced in the cytoplasm as a soluble, hydrophilic polypeptide. It subsequently undergoes a conformational change, folding into a stable helical bundle that autonomously integrates into the membrane. Downstream cargo proteins are then positioned for facilitated, spontaneous folding and membrane integration, possibly in a co-translational manner. A Mistic polypeptide's ability to autonomously associate with the membrane may (but need not) account for its high efficiency in assisting the production and integration of downstream fusion proteins into the membrane. Another, non-binding proposed mechanism for the membrane-associating activity of a Mistic polypeptide is shown in FIG. 15, Schematic II. In this model, it is proposed that the Mistic polypeptide undergoes a conformation rearrangement upon association with a membrane, which rearrangement facilitates the insertion of a Mistic fusion partner (e.g., IM protein) in the membrane.

Example 5

Mistic-L Structural Mutations do not Affect Membrane-Targeting Function

This example describes the functional characterization of additional Mistic-L variants. Among other things, such variants specify particular mutations that do and do not affect the membrane-associating and protein-trafficking functions of Mistic-L.

Figure 3:
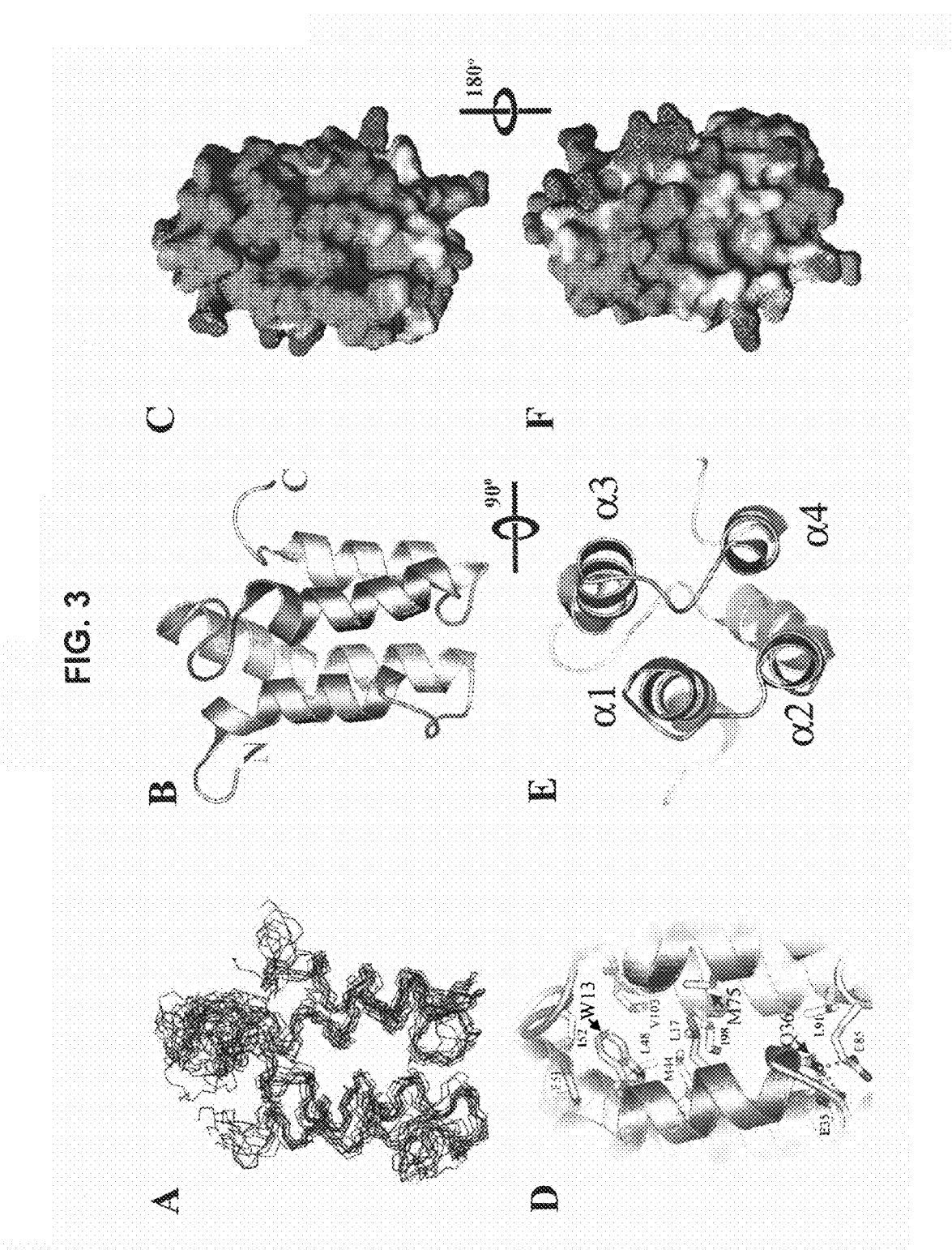
FIG. 3 shows several representations of Mistic-L tertiary structure.

To further demonstrate Mistic-L's direct role in assisting the production of recombinant IM proteins, mutations were introduced at three sites (residues 13, 36, and 75) within the core of the Mistic-L structure (see FIGS. 1A and 3D). In particular, W13A, Q36E, or M75A mutations were made using a Quickchange™ kit (Stratagene) in conformance with manufacturer's instructions. The three-dimension structure of Mistic-L (see generally FIG. 3 and, specifically, FIG. 3D), shows these residue to be in the core of the Mistic-L protein. Mutation (particularly, non-conservative mutation) of a core residue may disrupt the structural integrity of the protein.

Figure 7:
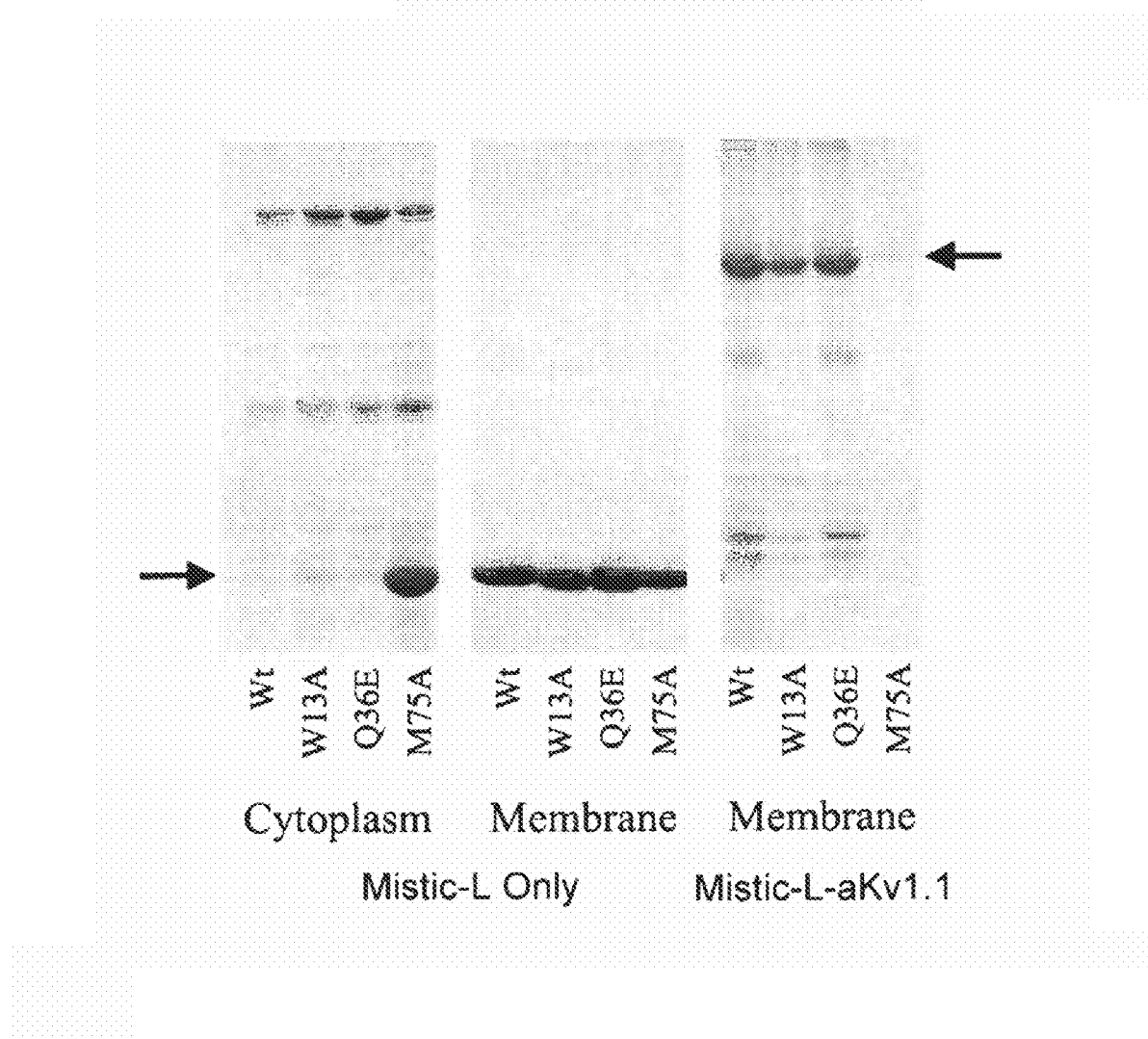
FIG. 7 shows three SDS-PAGE gels of Ni-NTA-isolated proteins from the indicated fraction of cells expressing wild-type or mutant Mistic-L ("Mistic-L Only") or fusion proteins comprising a potassium channel domain (aKv1.1) and wild-type or mutant Mistic-L domain ("Mistic-L-aKv1.1).

Wild type (Wt) and mutant Mistic-L proteins were expressed in *E. coli* (as described in Example 1) either alone or fused to aKv1.1. The N-terminal T1 domain of aKv1.1 was deleted from fusion protein expression constructs to minimize proteolytic degradation artifacts (as described in Example 4). As shown in FIG. 7, wild type Mistic-L and all three Mistic-L mutants localized to the cell membrane (lanes 5-8 from the left). No appreciable accumulation of the W13A or Q36E mutant in the cytoplasm was observed (lanes 1-3 from the left).

When expressed as a fusion protein with modified aKv1.1, the W13A and Q36E mutants retained the ability to traffic aKv1.1 to the cell membrane (FIG. 7, lanes 10 and 11 from the left). Mutation of Trp13 to Ala (W13A) reduced the amount of W13A-aKv1.1 fusion protein observed in the membrane fraction by 2-3 fold (compare FIG. 7, lanes 9 and 10 from the left). However, such a minor reduction indicates that Mistic-L residue 13 can be modified without substantial effect on protein function.

In comparison, the M75A-aKv1.1 fusion protein was not detected in the cell membrane fraction (right-most lane of FIG. 7). This result suggests that non-conservative mutations of the methionine at position 75 (such as to alanine) of wild-type Mistic-L sufficiently destabilized Mistic-L's structure such that it partitioned between the membrane and the cytoplasm, and failed to traffic fused aKv1.1 to the membrane.

This Example demonstrates that at least two core Mistic-L residues tolerate mutation without substantial adverse effects on protein function. However, non-conservative mutation of Met75 should be avoided to maintain Mistic-L's membrane-associating and protein-trafficking functions.

Example 6

Linker Length can be Varied to Optimize Mistic Fusion Protein Expression

This Example demonstrates that the number of amino acids between a Mistic polypeptide domain and a fusion partner domain in a Mistic fusion protein can be varied to optimize expression of the fusion protein.

Figure 8:
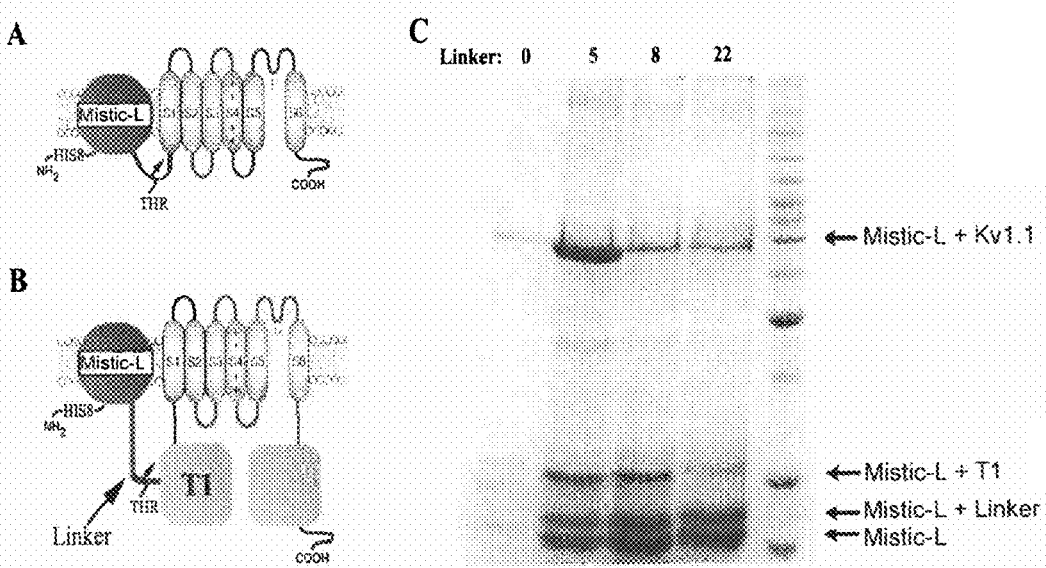
FIGS. 8A and 8B show schematic representations of Mistic-L-aKv1.1 fusion proteins incorporated into cell membranes.
FIG. 8C shows an SDS-gel of Ni-NTA purified Mistic-L-wt aKv1.1 fusion proteins having variable length linkers (0, 5, 8, and 32 amino acids, as indicated above the gel) between the Mistic-L and aKv1.1 domains.

As shown schematically in FIG. 8, wild-type Mistic-L was fused with a variable length linker (0, 5, 8, or 22 amino acids) to wild-type aKv1.1 (FIG. 8B) or to a truncated aKv1.1 (FIG. 8A), which has the N-terminal T1 domain removed. These Mistic-L fusion proteins were then expressed in *E. coli* as described in Example 1, purified by Ni-NTA affinity chromatography, and separated on SDS-PAGE gels.

As shown in FIG. 8C, a Mistic-L-wt aKv1.1 fusion protein was observed regardless of the length of the linker between the Mistic-L and wt aKv1.1 domains. Nonetheless, comparatively higher expression was observed for the Mistic-L-wt aKv1.1 fusion protein having a linker of 5 amino acids connecting Mistic-L to the aKv1.1 T1 domain. As further shown in FIG. 8C, Mistic-L and Mistic-L "+T1" side products were observed in each sample, which suggests that the domain linker and the amino acid sequence between the T1 domain and the TM pore-forming domain are protease sensitive.

Example 7

Exemplar Mistic Expression Vectors

This Example describes several representative expression vectors that are useful for the expression of Mistic fusion proteins (such as, Mistic-L-, M1-, M2-, M3-, and M4-IM protein fusions) in bacteria.

Gateway™ technology was selected for the construction of exemplary Mistic polypeptide expression vectors. As known to the ordinarily skilled artisan, Gateway™-adapted vectors permit rapid and efficient transfer of DNA segments (such as IM protein coding sequences) between multiple different cloning vectors while maintaining orientation and reading frame of the transferred DNA segments (see, for example, Walthout et al., *Meth. Enzymol.*, 328:575, 2000; and U.S. Pat. Nos. 6,720,140; 6,277,608; 6,270,969; 6,171,861; 6,143,557; and 5,888,732).

Figure 9:
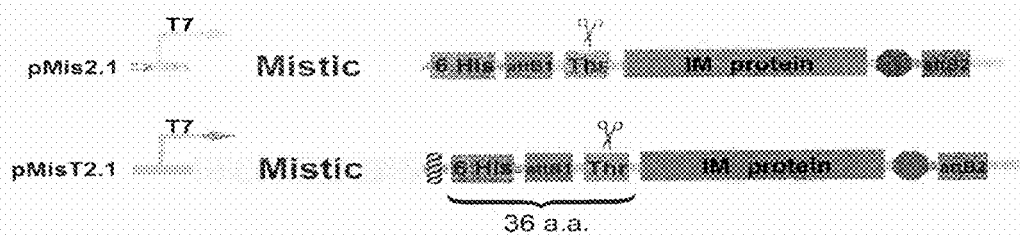
FIG. 9 shows schematic representations of Gateway™-adapted Mistic polypeptide fusion vectors. The schematic diagrams in panel A depict the cloning regions of pMis2.1 and pMisT2.1 after recombination with a pENTR vector. A thrombin cleavage site is abbreviated "Thr." An exogenous transmembrane (TM) helix (spiral bar) of pMisT2.1 is located between the sequences encoding a Mistic polypeptide and the 6 His tag.
Figure 9:
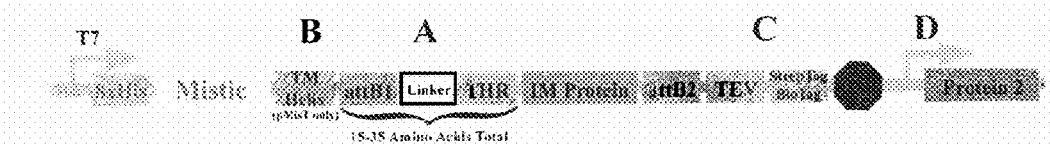

As shown in FIG. 9A, pMis2.1 and pMisT2.1 vectors can be used to express fusion proteins having an N-terminal Mistic polypeptide (e.g., Mistic-L, M1, M2, M3, or M4, or functional fragments or variants of any thereof) domain. pMis2.1 has a peptide tag (e.g., "6 His") linked in frame to the C-terminus of the Mistic domain. pMisT2.1 has an exogenous helix domain cloned in-frame between the Mistic domain and the peptide tag; thus, the exogenous helix follows the C-terminus of the Mistic domain and precedes the N-terminus of a peptide tag. In each of these vectors, a protease-recognition sequence (e.g., "Thr" for thrombin recognition site) and a fusion partner domain (e.g., "IM protein") are flanked by recombination sites ("attB1" and "attB2"), which permits the protease-recognition site and fusion partner domain (collectively, the "fusion partner cassette") to be cloned in and out of the Gateway™-based vector with ease. Given this vector configuration, any fusion partner cassette can be ready inserted into the vector and expressed with an N-terminal Mistic domain.

As shown in Example 4, many fusion partners are successfully expressed when linked to an N-terminal Mistic-L domain by a relatively short linker (e.g., 15-36 amino acids). Nonetheless, it is recognized that geometric restrictions may arise in connection with some IM fusion partners. The natural orientation of an IM fusion partner domain in the membrane may not correspond with the geometry permitted by the fusion protein. For example, the N-terminus of a fusion partner domain may not normally be located on the same side of the membrane as the C-terminus of the Mistic domain. pMisT2.1 was designed to relieve such constraints. The exogenous transmembrane helix (such as, a KvPae transmembrane helix, a S1 transmembrane domain from a *Pseudomonas* K$^+$ channel, or a synthetic helix), which is inserted generally between the Mistic and fusion partner domains, traverses the membrane to permit a fusion partner domain to assume its natural orientation with respect to the membrane.

Another geometric consideration taken into account in vector design was the distance between the natural N-terminus of an IM fusion partner and the membrane. To accommodate this distance, pMis2.1 and pMisT2.1 were engineered to have up to 36 amino acids between the C-terminus of the Mistic domain or the C-terminus of the exogenous helix and the N-terminus of an IM fusion partner, respectively. As shown in FIG. 9A, the up to 36 amino acids can include sequences encoding other functions (such as, peptide tag or protease-recognition site).

FIG. 9B shows another representative Mistic fusion protein expression vector design, which is also based on Gateway™ technology. In this implementation, sequences encoding a variable-length linker, a protease-recognition site, and a fusion partner protein (e.g., "IM Protein") are contained within the recombination elements (attB1 and attB2). As discussed above, the sequences flanked by the recombination elements (referred to as the fusion partner cassette) can be cloned in and out of the Gateway™-based vector with particular ease. In the illustrated vector, the fusion partner cassette is flanked on the N-terminus by sequences encoding an N-tagged (e.g., His-tagged) Mistic domain followed by an optional exogenous helix ("TM helix"), and on the C-terminus by a second protease-recognition site (e.g., "TEV") and a second peptide tag (e.g., "StrepTag" or "BioTag"). The second C-terminal peptide tag can be used to isolate full-length Mistic fusion proteins (or fusion partner domains) from truncated degradation products. Moreover, the C-terminal affinity tag can be subsequently (and optionally) removed using the second protease processing site.

The vector shown in FIG. 9B further illustrates a second promoter ("D") driving the expression of another protein ("Protein 2"). In this optional configuration, the illustrated vector can be used to express membrane protein systems involving more than one unique protein chain. Di-cistronic vectors with dual Mistic domain fusions and single Mistic domain fusions are contemplated. In one specific example, the Kv channel, rKv4.2, will be expressed in association with an interacting IM protein, di-peptidyl peptidase (DPP) VI, or a cytoplasmic modulator, K$^+$ channel interacting protein (KChIP).

Example 8

Mistic-L Stabilizes its Fusion Partners

This Example demonstrates that a representative Mistic polypeptide facilitates (for example, stabilizes) the expression of its fusion partner(s). Although not being bound by any one theory, it is believed that a Mistic polypeptide stabilizes its fusion partner by increasing its solubility and/or by preventing its aggregation.

Figure 12:
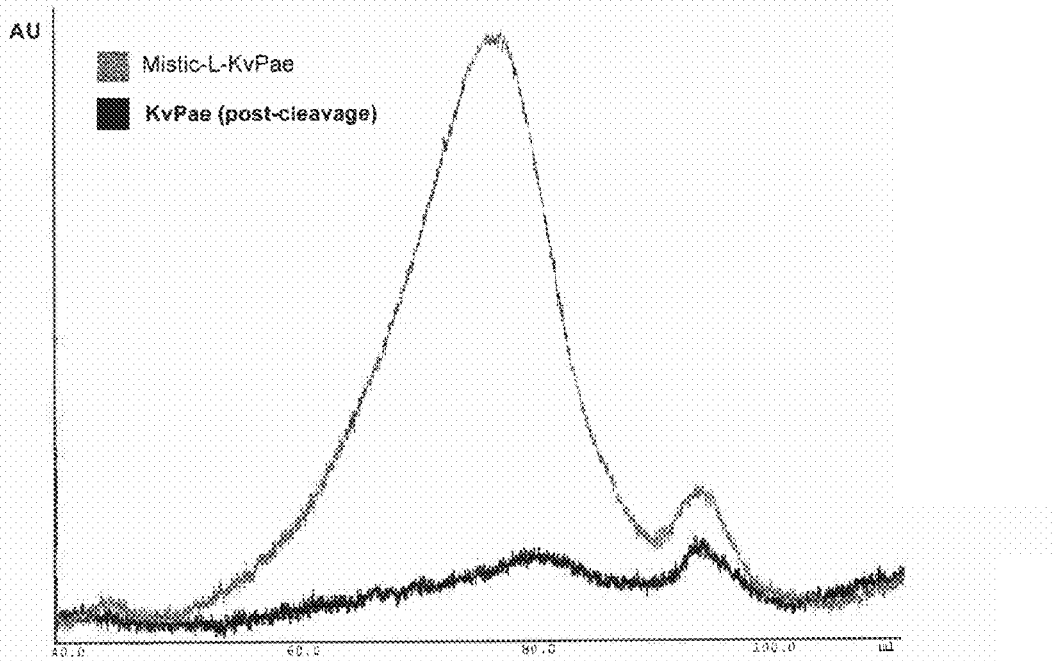
FIG. 12 is a gel filtration elution profile a Mistic-L-KvPae fusion protein and a KvPae fusion partner domain after thrombin removal of the Mistic-L domain by overnight digestion at room temperature.

FIG. 12 illustrates that Mistic-L can stabilize an IM protein fusion partner. The figure shows the gel filtration elution profile a Mistic-L-KvPae fusion protein and a KvPae fusion partner domain after thrombin removal of the Mistic-L domain by overnight digestion at room temperature. Gel filtration was performed using a Superdex 200™ column run at 1 ml per minute in a solution of 300 mM KCl, 50 mM Tris (pH 8.0), 3 mM LDAO, 1 mM DTT.

Mistic-L-KvPae and cleaved KvPae are represented by the leftmost and rightmost peaks, respectively, of the elution profile shown in FIG. 12. As indicated by the size of the Mistic-L-KvPae peak, a large amount of Mistic-L-KvPae is recovered in the absence of thrombin cleavage of the fusion partners. However, when the fusion partners were cleaved, more than 90% of the KvPae protein was lost, mostly due to protein aggregation (aggregates were removed from the sample by a pre-filter to avoid clogging the column) or precipitation (the sample became cloudy during the course of the thrombin digestion).

This Example indicates that Mistic polypeptides assist in maintaining a fusion partner (e.g., KvPae) in solution (for example, by increasing solubility), or preventing its aggregation (for example by sterically separating aggregation prone regions or domains of KvPae). This and other disclosed properties of Mistic polypeptides (such as Mistic-L, M1, M2, M3, and M4) permit the successful heterologous expression of fusion partner proteins (such as membrane proteins) that otherwise could not be expressed at all or in useful amounts.

Example 9

M1 is a Functional Fragment of Mistic-L

Sequence analysis revealed that the *B. subtilis* gene for Mistic-L may also have an internal, alternative translation start site that would yield an 84 amino acid protein. Thus, a truncated form of Mistic-L, which included amino acid residues 27 to 110, was produced. This Mistic-L variant, which lacks the N-terminus, was named "M1." M1 was created by full vector PCR using oligos annealing directly upstream and downstream of, and directed away from, the 26 amino acids being deleted, followed by blunt ended ligation of the resulting PCR product.

M1 was fused to a variety of cargo proteins, including Alk3, BmpRII, or CRFR2β in a manner analogous to that described in Example 4 for the making of Mistic-L fusion proteins. As shown in Example 11, M1 retained the membrane-associating functions of Mistic-L, which proves M1 a functional fragment of Mistic-L and shows that the 26 N-terminal amino acids of Mistic-L are not necessary for Mistic polypeptides to associate with a membrane.

Example 10

Isolation of Several Mistic-L/M1 Orthologs

This Example demonstrates the cloning of several Mistic-L and Mistic M1 orthologs.

Genomic DNA, obtained from the *Bacillus* Genetic Stock Center (BGSC), from four *Bacillus* species (*B. licheniformis*, BGSCID 5A36; *B. mojavensis*, BGSCID 28A1; *B. atrophaeus*, BGSCID 11A1; and *B. pumilus*, BGSCID 8A3) was amplified using two "MisticSeeker" oligonucleotides: ATGCTAATACGACTCACTAT-AGGGGCTCTTTACTTTAAATTGTGCCC (SEQ ID NO: 186); and ATGGCTAGTTATTGCTCAGCGGCCGACT-GWNGANACNGTNABNABNGCCCACCADATNCC (SEQ ID NO: 187). The MisticSeeker oligonucleotides were (are) complementary to conserved regions of the genes upstream (YugP) and downstream (YugO-b) of the Mistic-L gene in the *Bacillus subtilis* genome.

PCR was conducted for 30 cycles with one minute incubations between melting (94° C.), annealing (50° C.), and elongation (72° C.), temperatures using Vent DNA polymerase. The amplified product was sequenced using the same MisticSeeker oligos. For *B. licheniformis* (M2), *B. mojavensis* (M3), and *B. atrophaeus* (M4), 252 base pair open-reading-frames were found that translated to proteins homologous to the C-terminal 84 amino acids of the *B. subtilis* Mistic-L protein. In all cases, the Mistic homologue is located just upstream and partially overlapping a K+ channel gene (YugO-C). The identity conservation for these homologues varied from 93% to 62% (see FIG. 13).

The conservation pattern between the homologues was mapped to the Mistic-L structure (see FIG. 13). Non-conservative residues (numbered 1-9 in FIG. 13) mapped to the flexible loop regions of the protein. This pattern indicates that the overall structural fold of the protein, less the N-terminal helix, is common to Mistic polypeptides (e.g., Mistic-L (including M1), M2, M3 and M4). It further indicates that the flexible loop regions of a Mistic polypeptide can absorb non-conservative amino acid substitutions with no substantial adverse functional consequence.

Example 11

Proteins Fused to Other Mistic Polypeptide are Targeted to the Membrane

This Example demonstrates that M1, M2, M3, and M4 possess the same membrane-associating property as Mistic-L and are similarly capable of facilitating the association of a fusion partner protein with a membrane and further facilitating the isolation of relatively large amounts of otherwise difficult-to-isolate fusion partners (such as IM proteins).

Fusion constructs comprising M1, M2, M3, or M4 fused to ALK3, BMPRII, or CRFRIIβ were constructed in a manner similar to that described for Mistic-L fusion proteins in Example 4. The amino acid sequences and corresponding nucleic acid sequences for these fusion constructs are provided in SEQ ID NOs: 196-219 (with odd numbers being nucleic acid sequences and even numbers being amino acid sequences; see also Table 1) and amino acid sequences for these His-tagged M1-M4 fusion proteins were expressed in bacterial host cells, as described in Example 2. Briefly, freshly transformed colonies were cultured in TB and induced with 0.1 mM isopropyl-β-D-thiogalactopyranoside (IPTG) at an O.D. of 1.0. Growth was continued overnight at 10-18° C. Cells were harvested and resuspended in 50 mM Tris pH 8.0, 300 mM KCl, 10% glycerol, 10 mM imidazole with 1 mg/ml lysozyme. Cells were disrupted by sonication on ice and membranes were pelleted by high speed centrifugation. Membranes were solubilized by sonication in the above buffer with the addition of 20 mM LDAO. Insoluble material was removed by high speed centrifugation and the desired fusion protein was optionally purified from the resulting supernatant using Ni-NTA affinity chromatography (Qiagen). Membrane-associated proteins in the presence or absence of thrombin (which cleaved the cargo domain from the Mistic domain) were visualized on SDS gels.

Figure 14:
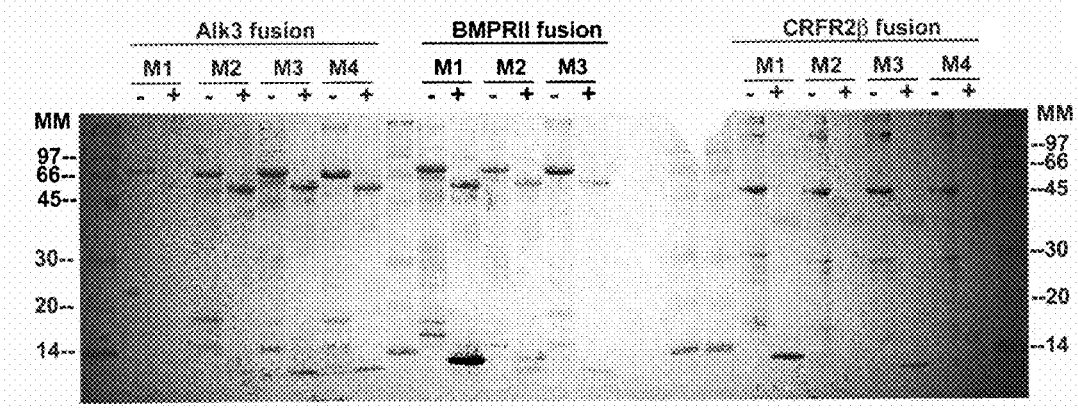
FIG. 14 is a composite of several SDS gels showing the successful expression of M1, M2, M3 or M4 fusions with Alk3, BMPRII, or CRFR2β (columns marked "–") and the equally successful cleavage of the particular cargo protein from its respective Mistic domain in the presence of thrombin (columns marked "+").

As shown in FIG. 14, each of M1, M2, M3 and M4 fused to their respective cargoes (Alk3, BMPRII, and CRFR2β) were isolated in the absence of thrombin (lanes marked "−"). In the presence of thrombin (lanes marked "+"), the respective cargo proteins were released from the Mistic domains (see band at approximately 70 kD for Alk3 and approximately 55 kD for BMPRII, and bands at approximately 45 kD and 33 kD for CRFR2β). In all cases, the level of expression of M1, M2, M3 or M4 fusion proteins was largely comparable to that of Mistic-L fusion proteins.

While this invention has been described with an emphasis upon particular embodiments, it will be obvious to those of ordinary skill in the art that variations of the particular embodiments may be used and it is intended that the invention may be practiced otherwise than as specifically described herein. Accordingly, this invention includes all modifications encompassed within the spirit and scope of the invention as defined by the claims following Table 4.

TABLE 4

| Mistic-L Atomic Structure Coordinates | | | | | | | | | |
|---|---|---|---|---|---|---|---|---|---|
| ATOM | 1 | N | CYS | 3 | −14.858 | −5.458 | −2.728 | 1.00 | 0.00 |
| ATOM | 2 | H | CYS | 3 | −14.461 | −4.881 | −3.442 | 1.00 | 0.00 |
| ATOM | 3 | CA | CYS | 3 | −14.902 | −4.856 | −1.406 | 1.00 | 0.00 |

TABLE 4-continued

Mistic-L Atomic Structure Coordinates

| ATOM | 4 | HA | CYS | 3 | −14.452 | −5.574 | −0.720 | 1.00 | 0.00 |
| ATOM | 5 | CB | CYS | 3 | −14.067 | −3.575 | −1.339 | 1.00 | 0.00 |
| ATOM | 6 | 2HB | CYS | 3 | −14.280 | −2.948 | −2.205 | 1.00 | 0.00 |
| ATOM | 7 | QB | CYS | 3 | −14.280 | −2.948 | −2.205 | 1.00 | 0.00 |
| ATOM | 8 | SG | CYS | 3 | −14.442 | −2.664 | 0.202 | 1.00 | 0.00 |
| ATOM | 9 | HG | CYS | 3 | −15.293 | −1.803 | −0.349 | 1.00 | 0.00 |
| ATOM | 10 | C | CYS | 3 | −16.366 | −4.601 | −1.043 | 1.00 | 0.00 |
| ATOM | 11 | O | CYS | 3 | −16.861 | −5.123 | −0.045 | 1.00 | 0.00 |
| ATOM | 12 | N | THR | 4 | −17.018 | −3.801 | −1.873 | 1.00 | 0.00 |
| ATOM | 13 | H | THR | 4 | −16.608 | −3.381 | −2.683 | 1.00 | 0.00 |
| ATOM | 14 | CA | THR | 4 | −18.416 | −3.472 | −1.652 | 1.00 | 0.00 |
| ATOM | 15 | HA | THR | 4 | −18.660 | −3.691 | −0.612 | 1.00 | 0.00 |
| ATOM | 16 | CB | THR | 4 | −18.596 | −1.974 | −1.913 | 1.00 | 0.00 |
| ATOM | 17 | HB | THR | 4 | −18.110 | −1.682 | −2.844 | 1.00 | 0.00 |
| ATOM | 18 | QG2 | THR | 4 | −20.416 | −1.452 | −1.906 | 1.00 | 0.00 |
| ATOM | 19 | OG1 | THR | 4 | −18.052 | −1.352 | −0.753 | 1.00 | 0.00 |
| ATOM | 20 | 1HG | THR | 4 | −17.357 | −0.683 | −1.019 | 1.00 | 0.00 |
| ATOM | 21 | CG2 | THR | 4 | −20.067 | −1.553 | −1.907 | 1.00 | 0.00 |
| ATOM | 22 | 1HG2 | THR | 4 | −20.621 | −2.174 | −1.203 | 1.00 | 0.00 |
| ATOM | 23 | 2HG2 | THR | 4 | −20.143 | −0.508 | −1.606 | 1.00 | 0.00 |
| ATOM | 24 | 3HG2 | THR | 4 | −20.485 | −1.674 | −2.907 | 1.00 | 0.00 |
| ATOM | 25 | C | THR | 4 | −19.316 | −4.353 | −2.520 | 1.00 | 0.00 |
| ATOM | 26 | O | THR | 4 | −20.538 | −4.325 | −2.382 | 1.00 | 0.00 |
| ATOM | 27 | N | PHE | 5 | −18.677 | −5.114 | −3.396 | 1.00 | 0.00 |
| ATOM | 28 | H | PHE | 5 | −17.683 | −5.131 | −3.501 | 1.00 | 0.00 |
| ATOM | 29 | CA | PHE | 5 | −19.404 | −6.002 | −4.286 | 1.00 | 0.00 |
| ATOM | 30 | HA | PHE | 5 | −20.453 | −5.709 | −4.251 | 1.00 | 0.00 |
| ATOM | 31 | CB | PHE | 5 | −18.782 | −5.850 | −5.675 | 1.00 | 0.00 |
| ATOM | 32 | 2HB | PHE | 5 | −18.522 | −6.838 | −6.057 | 1.00 | 0.00 |
| ATOM | 33 | QB | PHE | 5 | −18.522 | −6.838 | −6.057 | 1.00 | 0.00 |
| ATOM | 34 | QD | PHE | 5 | −19.768 | −5.089 | −6.780 | 1.00 | 0.00 |
| ATOM | 35 | QE | PHE | 5 | −21.256 | −3.941 | −8.444 | 1.00 | 0.00 |
| ATOM | 36 | QR | PHE | 5 | −20.806 | −4.288 | −7.941 | 1.00 | 0.00 |
| ATOM | 37 | CG | PHE | 5 | −19.688 | −5.151 | −6.690 | 1.00 | 0.00 |
| ATOM | 38 | CD1 | PHE | 5 | −19.410 | −3.881 | −7.088 | 1.00 | 0.00 |
| ATOM | 39 | 1HD | PHE | 5 | −18.541 | −3.361 | −6.684 | 1.00 | 0.00 |
| ATOM | 40 | CE1 | PHE | 5 | −20.252 | −3.231 | −8.030 | 1.00 | 0.00 |
| ATOM | 41 | 1HE | PHE | 5 | −20.028 | −2.213 | −8.349 | 1.00 | 0.00 |
| ATOM | 42 | CZ | PHE | 5 | −21.335 | −3.879 | −8.534 | 1.00 | 0.00 |
| ATOM | 43 | HZ | PHE | 5 | −21.982 | −3.381 | −9.257 | 1.00 | 0.00 |
| ATOM | 44 | CE2 | PHE | 5 | −21.614 | −5.149 | −8.136 | 1.00 | 0.00 |
| ATOM | 45 | 2HE | PHE | 5 | −22.483 | −5.670 | −8.540 | 1.00 | 0.00 |
| ATOM | 46 | CD2 | PHE | 5 | −20.772 | −5.799 | −7.194 | 1.00 | 0.00 |
| ATOM | 47 | 2HD | PHE | 5 | −20.996 | −6.818 | −6.875 | 1.00 | 0.00 |
| ATOM | 48 | C | PHE | 5 | −19.270 | −7.460 | −3.838 | 1.00 | 0.00 |
| ATOM | 49 | O | PHE | 5 | −20.192 | −8.016 | −3.243 | 1.00 | 0.00 |
| ATOM | 50 | N | PHE | 6 | −18.116 | −8.035 | −4.139 | 1.00 | 0.00 |
| ATOM | 51 | H | PHE | 6 | −17.371 | −7.574 | −4.622 | 1.00 | 0.00 |
| ATOM | 52 | CA | PHE | 6 | −17.849 | −9.416 | −3.773 | 1.00 | 0.00 |
| ATOM | 53 | HA | PHE | 6 | −18.729 | −9.787 | −3.248 | 1.00 | 0.00 |
| ATOM | 54 | CB | PHE | 6 | −17.559 | −10.173 | −5.070 | 1.00 | 0.00 |
| ATOM | 55 | 2HB | PHE | 6 | −16.702 | −9.714 | −5.564 | 1.00 | 0.00 |
| ATOM | 56 | QB | PHE | 6 | −16.702 | −9.714 | −5.564 | 1.00 | 0.00 |
| ATOM | 57 | QD | PHE | 6 | −17.252 | −11.795 | −4.853 | 1.00 | 0.00 |
| ATOM | 58 | QE | PHE | 6 | −16.788 | −14.240 | −4.526 | 1.00 | 0.00 |
| ATOM | 59 | QR | PHE | 6 | −16.928 | −13.501 | −4.625 | 1.00 | 0.00 |
| ATOM | 60 | CG | PHE | 6 | −17.277 | −11.664 | −4.871 | 1.00 | 0.00 |
| ATOM | 61 | CD1 | PHE | 6 | −18.275 | −12.573 | −5.033 | 1.00 | 0.00 |
| ATOM | 62 | 1HD | PHE | 6 | −19.277 | −12.239 | −5.306 | 1.00 | 0.00 |
| ATOM | 63 | CE1 | PHE | 6 | −18.013 | −13.955 | −4.848 | 1.00 | 0.00 |
| ATOM | 64 | 1HE | PHE | 6 | −18.813 | −14.685 | −4.978 | 1.00 | 0.00 |
| ATOM | 65 | CZ | PHE | 6 | −16.764 | −14.371 | −4.508 | 1.00 | 0.00 |
| ATOM | 66 | HZ | PHE | 6 | −16.562 | −15.433 | −4.366 | 1.00 | 0.00 |
| ATOM | 67 | CE2 | PHE | 6 | −15.765 | −13.463 | −4.346 | 1.00 | 0.00 |
| ATOM | 68 | 2HE | PHE | 6 | −14.764 | −13.795 | −4.073 | 1.00 | 0.00 |
| ATOM | 69 | CD2 | PHE | 6 | −16.027 | −12.079 | −4.531 | 1.00 | 0.00 |
| ATOM | 70 | 2HD | PHE | 6 | −15.227 | −11.351 | −4.401 | 1.00 | 0.00 |
| ATOM | 71 | C | PHE | 6 | −16.630 | −9.514 | −2.855 | 1.00 | 0.00 |
| ATOM | 72 | O | PHE | 6 | −16.750 | −9.918 | −1.700 | 1.00 | 0.00 |
| ATOM | 73 | N | GLU− | 7 | −15.484 | −9.140 | −3.404 | 1.00 | 0.00 |
| ATOM | 74 | H | GLU− | 7 | −15.395 | −8.814 | −4.345 | 1.00 | 0.00 |
| ATOM | 75 | CA | GLU− | 7 | −14.243 | −9.182 | −2.649 | 1.00 | 0.00 |
| ATOM | 76 | HA | GLU− | 7 | −13.973 | −10.237 | −2.595 | 1.00 | 0.00 |
| ATOM | 77 | CB | GLU− | 7 | −13.134 | −8.417 | −3.374 | 1.00 | 0.00 |
| ATOM | 78 | 2HB | GLU− | 7 | −12.239 | −8.392 | −2.753 | 1.00 | 0.00 |
| ATOM | 79 | QB | GLU− | 7 | −12.239 | −8.392 | −2.753 | 1.00 | 0.00 |
| ATOM | 80 | CG | GLU− | 7 | −12.809 | −9.067 | −4.721 | 1.00 | 0.00 |
| ATOM | 81 | 2HG | GLU− | 7 | −12.114 | −8.436 | −5.274 | 1.00 | 0.00 |

TABLE 4-continued

Mistic-L Atomic Structure Coordinates

| ATOM | 82 | QG | GLU− | 7 | −12.114 | −8.436 | −5.274 | 1.00 | 0.00 |
|---|---|---|---|---|---|---|---|---|---|
| ATOM | 83 | CD | GLU− | 7 | −12.200 | −10.457 | −4.526 | 1.00 | 0.00 |
| ATOM | 84 | OE1 | GLU− | 7 | −12.995 | −11.411 | −4.389 | 1.00 | 0.00 |
| ATOM | 85 | OE2 | GLU− | 7 | −10.951 | −10.533 | −4.517 | 1.00 | 0.00 |
| ATOM | 86 | C | GLU− | 7 | −14.460 | −8.628 | −1.240 | 1.00 | 0.00 |
| ATOM | 87 | O | GLU− | 7 | −15.502 | −8.039 | −0.954 | 1.00 | 0.00 |
| ATOM | 88 | N | LYS+ | 8 | −13.461 | −8.836 | −0.396 | 1.00 | 0.00 |
| ATOM | 89 | H | LYS+ | 8 | −12.617 | −9.317 | −0.635 | 1.00 | 0.00 |
| ATOM | 90 | CA | LYS+ | 8 | −13.530 | −8.365 | 0.977 | 1.00 | 0.00 |
| ATOM | 91 | HA | LYS+ | 8 | −14.464 | −7.814 | 1.086 | 1.00 | 0.00 |
| ATOM | 92 | CB | LYS+ | 8 | −13.585 | −9.547 | 1.947 | 1.00 | 0.00 |
| ATOM | 93 | 2HB | LYS+ | 8 | −12.574 | −9.883 | 2.175 | 1.00 | 0.00 |
| ATOM | 94 | QB | LYS+ | 8 | −12.574 | −9.883 | 2.175 | 1.00 | 0.00 |
| ATOM | 95 | CG | LYS+ | 8 | −14.304 | −9.161 | 3.242 | 1.00 | 0.00 |
| ATOM | 96 | 2HG | LYS+ | 8 | −14.899 | −8.263 | 3.077 | 1.00 | 0.00 |
| ATOM | 97 | QG | LYS+ | 8 | −14.899 | −8.263 | 3.077 | 1.00 | 0.00 |
| ATOM | 98 | CD | LYS+ | 8 | −15.207 | −10.296 | 3.728 | 1.00 | 0.00 |
| ATOM | 99 | 2HD | LYS+ | 8 | −15.355 | −10.212 | 4.804 | 1.00 | 0.00 |
| ATOM | 100 | QD | LYS+ | 8 | −15.355 | −10.212 | 4.804 | 1.00 | 0.00 |
| ATOM | 101 | CE | LYS+ | 8 | −16.562 | −10.260 | 3.017 | 1.00 | 0.00 |
| ATOM | 102 | 2HE | LYS+ | 8 | −16.696 | −11.169 | 2.431 | 1.00 | 0.00 |
| ATOM | 103 | QE | LYS+ | 8 | −16.696 | −11.169 | 2.431 | 1.00 | 0.00 |
| ATOM | 104 | NZ | LYS+ | 8 | −17.660 | −10.130 | 4.001 | 1.00 | 0.00 |
| ATOM | 105 | 1HZ | LYS+ | 8 | −18.409 | −10.744 | 3.749 | 1.00 | 0.00 |
| ATOM | 106 | 2HZ | LYS+ | 8 | −17.323 | −10.371 | 4.911 | 1.00 | 0.00 |
| ATOM | 107 | 3HZ | LYS+ | 8 | −17.992 | −9.186 | 4.007 | 1.00 | 0.00 |
| ATOM | 108 | QZ | LYS+ | 8 | −17.908 | −10.100 | 4.222 | 1.00 | 0.00 |
| ATOM | 109 | C | LYS+ | 8 | −12.368 | −7.407 | 1.241 | 1.00 | 0.00 |
| ATOM | 110 | O | LYS+ | 8 | −12.559 | −6.193 | 1.298 | 1.00 | 0.00 |
| ATOM | 111 | N | HIS+ | 9 | −11.186 | −7.988 | 1.398 | 1.00 | 0.00 |
| ATOM | 112 | H | HIS+ | 9 | −11.039 | −8.976 | 1.351 | 1.00 | 0.00 |
| ATOM | 113 | CA | HIS+ | 9 | −9.993 | −7.200 | 1.655 | 1.00 | 0.00 |
| ATOM | 114 | HA | HIS+ | 9 | −10.331 | −6.231 | 2.022 | 1.00 | 0.00 |
| ATOM | 115 | CB | HIS+ | 9 | −9.143 | −7.844 | 2.752 | 1.00 | 0.00 |
| ATOM | 116 | 2HB | HIS+ | 9 | −9.503 | −7.504 | 3.723 | 1.00 | 0.00 |
| ATOM | 117 | QB | HIS+ | 9 | −9.503 | −7.504 | 3.723 | 1.00 | 0.00 |
| ATOM | 118 | CG | HIS+ | 9 | −9.153 | −9.354 | 2.729 | 1.00 | 0.00 |
| ATOM | 119 | ND1 | HIS+ | 9 | −9.771 | −10.114 | 3.707 | 1.00 | 0.00 |
| ATOM | 120 | CD2 | HIS+ | 9 | −8.615 | −10.235 | 1.838 | 1.00 | 0.00 |
| ATOM | 121 | 1HD | HIS+ | 9 | −10.260 | −9.759 | 4.503 | 1.00 | 0.00 |
| ATOM | 122 | CE1 | HIS+ | 9 | −9.605 | −11.395 | 3.408 | 1.00 | 0.00 |
| ATOM | 123 | NE2 | HIS+ | 9 | −8.888 | −11.467 | 2.249 | 1.00 | 0.00 |
| ATOM | 124 | 2HD | HIS+ | 9 | −8.056 | −9.972 | 0.940 | 1.00 | 0.00 |
| ATOM | 125 | 1HE | HIS+ | 9 | −9.976 | −12.241 | 3.986 | 1.00 | 0.00 |
| ATOM | 126 | C | HIS+ | 9 | −9.221 | −6.997 | 0.350 | 1.00 | 0.00 |
| ATOM | 127 | O | HIS+ | 9 | −8.445 | −6.051 | 0.225 | 1.00 | 0.00 |
| ATOM | 128 | N | HIS+ | 10 | −9.462 | −7.900 | −0.590 | 1.00 | 0.00 |
| ATOM | 129 | H | HIS+ | 10 | −10.094 | −8.666 | −0.479 | 1.00 | 0.00 |
| ATOM | 130 | CA | HIS+ | 10 | −8.799 | −7.832 | −1.880 | 1.00 | 0.00 |
| ATOM | 131 | HA | HIS+ | 10 | −7.730 | −7.921 | −1.688 | 1.00 | 0.00 |
| ATOM | 132 | CB | HIS+ | 10 | −9.214 | −9.006 | −2.767 | 1.00 | 0.00 |
| ATOM | 133 | 2HB | HIS+ | 10 | −8.555 | −9.045 | −3.635 | 1.00 | 0.00 |
| ATOM | 134 | QB | HIS+ | 10 | −8.555 | −9.045 | −3.635 | 1.00 | 0.00 |
| ATOM | 135 | CG | HIS+ | 10 | −9.181 | −10.345 | −2.069 | 1.00 | 0.00 |
| ATOM | 136 | ND1 | HIS+ | 10 | −8.059 | −10.822 | −1.416 | 1.00 | 0.00 |
| ATOM | 137 | CD2 | HIS+ | 10 | −10.145 | −11.300 | −1.928 | 1.00 | 0.00 |
| ATOM | 138 | 1HD | HIS+ | 10 | −7.181 | −10.349 | −1.339 | 1.00 | 0.00 |
| ATOM | 139 | CE1 | HIS+ | 10 | −8.344 | −12.012 | −0.908 | 1.00 | 0.00 |
| ATOM | 140 | NE2 | HIS+ | 10 | −9.637 | −12.307 | −1.228 | 1.00 | 0.00 |
| ATOM | 141 | 2HD | HIS+ | 10 | −11.158 | −11.247 | −2.324 | 1.00 | 0.00 |
| ATOM | 142 | 1HE | HIS+ | 10 | −7.665 | −12.645 | −0.337 | 1.00 | 0.00 |
| ATOM | 143 | C | HIS+ | 10 | −9.075 | −6.473 | −2.528 | 1.00 | 0.00 |
| ATOM | 144 | O | HIS+ | 10 | −8.281 | −5.992 | −3.335 | 1.00 | 0.00 |
| ATOM | 145 | N | ARG+ | 11 | −10.205 | −5.892 | −2.150 | 1.00 | 0.00 |
| ATOM | 146 | H | ARG+ | 11 | −10.845 | −6.289 | −1.493 | 1.00 | 0.00 |
| ATOM | 147 | CA | ARG+ | 11 | −10.595 | −4.599 | −2.684 | 1.00 | 0.00 |
| ATOM | 148 | HA | ARG+ | 11 | −9.816 | −4.346 | −3.401 | 1.00 | 0.00 |
| ATOM | 149 | CB | ARG+ | 11 | −11.954 | −4.680 | −3.383 | 1.00 | 0.00 |
| ATOM | 150 | 2HB | ARG+ | 11 | −12.477 | −3.728 | −3.282 | 1.00 | 0.00 |
| ATOM | 151 | QB | ARG+ | 11 | −12.477 | −3.728 | −3.282 | 1.00 | 0.00 |
| ATOM | 152 | CG | ARG+ | 11 | −11.789 | −5.023 | −4.864 | 1.00 | 0.00 |
| ATOM | 153 | 2HG | ARG+ | 11 | −11.155 | −5.903 | −4.968 | 1.00 | 0.00 |
| ATOM | 154 | QG | ARG+ | 11 | −11.155 | −5.903 | −4.968 | 1.00 | 0.00 |
| ATOM | 155 | CD | ARG+ | 11 | −13.146 | −5.283 | −5.522 | 1.00 | 0.00 |
| ATOM | 156 | 2HD | ARG+ | 11 | −13.740 | −5.950 | −4.897 | 1.00 | 0.00 |
| ATOM | 157 | QD | ARG+ | 11 | −13.740 | −5.950 | −4.897 | 1.00 | 0.00 |
| ATOM | 158 | NE | ARG+ | 11 | −13.864 | −4.005 | −5.723 | 1.00 | 0.00 |
| ATOM | 159 | HE | ARG+ | 11 | −13.500 | −3.188 | −5.277 | 1.00 | 0.00 |

TABLE 4-continued

Mistic-L Atomic Structure Coordinates

| ATOM | 160 | CZ | ARG+ | 11 | −14.972 | −3.875 | −6.467 | 1.00 | 0.00 |
| ATOM | 161 | NH1 | ARG+ | 11 | −15.555 | −2.675 | −6.594 | 1.00 | 0.00 |
| ATOM | 162 | 1HH1 | ARG+ | 11 | −16.382 | −2.578 | −7.148 | 1.00 | 0.00 |
| ATOM | 163 | 2HH1 | ARG+ | 11 | −15.166 | −1.878 | −6.133 | 1.00 | 0.00 |
| ATOM | 164 | QH1 | ARG+ | 11 | −15.774 | −2.228 | −6.641 | 1.00 | 0.00 |
| ATOM | 165 | NH2 | ARG+ | 11 | −15.494 | −4.943 | −7.084 | 1.00 | 0.00 |
| ATOM | 166 | 1HH2 | ARG+ | 11 | −16.319 | −4.846 | −7.638 | 1.00 | 0.00 |
| ATOM | 167 | 2HH2 | ARG+ | 11 | −15.057 | −5.838 | −6.989 | 1.00 | 0.00 |
| ATOM | 168 | QH2 | ARG+ | 11 | −15.688 | −5.342 | −7.314 | 1.00 | 0.00 |
| ATOM | 169 | C | ARG+ | 11 | −10.669 | −3.561 | −1.562 | 1.00 | 0.00 |
| ATOM | 170 | O | ARG+ | 11 | −11.197 | −2.468 | −1.755 | 1.00 | 0.00 |
| ATOM | 171 | N | LYS+ | 12 | −10.131 | −3.942 | −0.411 | 1.00 | 0.00 |
| ATOM | 172 | H | LYS+ | 12 | −9.704 | −4.833 | −0.261 | 1.00 | 0.00 |
| ATOM | 173 | CA | LYS+ | 12 | −10.129 | −3.058 | 0.742 | 1.00 | 0.00 |
| ATOM | 174 | HA | LYS+ | 12 | −10.930 | −2.332 | 0.600 | 1.00 | 0.00 |
| ATOM | 175 | CB | LYS+ | 12 | −10.448 | −3.841 | 2.017 | 1.00 | 0.00 |
| ATOM | 176 | 2HB | LYS+ | 12 | −9.595 | −4.459 | 2.293 | 1.00 | 0.00 |
| ATOM | 177 | QB | LYS+ | 12 | −9.595 | −4.459 | 2.293 | 1.00 | 0.00 |
| ATOM | 178 | CG | LYS+ | 12 | −10.794 | −2.894 | 3.169 | 1.00 | 0.00 |
| ATOM | 179 | 2HG | LYS+ | 12 | −10.271 | −1.947 | 3.035 | 1.00 | 0.00 |
| ATOM | 180 | QG | LYS+ | 12 | −10.271 | −1.947 | 3.035 | 1.00 | 0.00 |
| ATOM | 181 | CD | LYS+ | 12 | −12.302 | −2.646 | 3.241 | 1.00 | 0.00 |
| ATOM | 182 | 2HD | LYS+ | 12 | −12.837 | −3.557 | 2.976 | 1.00 | 0.00 |
| ATOM | 183 | QD | LYS+ | 12 | −12.837 | −3.557 | 2.976 | 1.00 | 0.00 |
| ATOM | 184 | CE | LYS+ | 12 | −12.716 | −2.194 | 4.643 | 1.00 | 0.00 |
| ATOM | 185 | 2HE | LYS+ | 12 | −12.333 | −1.192 | 4.837 | 1.00 | 0.00 |
| ATOM | 186 | QE | LYS+ | 12 | −12.333 | −1.192 | 4.837 | 1.00 | 0.00 |
| ATOM | 187 | NZ | LYS+ | 12 | −14.191 | −2.201 | 4.775 | 1.00 | 0.00 |
| ATOM | 188 | 1HZ | LYS+ | 12 | −14.466 | −1.536 | 5.469 | 1.00 | 0.00 |
| ATOM | 189 | 2HZ | LYS+ | 12 | −14.605 | −1.958 | 3.897 | 1.00 | 0.00 |
| ATOM | 190 | 3HZ | LYS+ | 12 | −14.496 | −3.113 | 5.047 | 1.00 | 0.00 |
| ATOM | 191 | QZ | LYS+ | 12 | −14.523 | −2.202 | 4.805 | 1.00 | 0.00 |
| ATOM | 192 | C | LYS+ | 12 | −8.798 | −2.306 | 0.800 | 1.00 | 0.00 |
| ATOM | 193 | O | LYS+ | 12 | −8.774 | −1.093 | 1.003 | 1.00 | 0.00 |
| ATOM | 194 | N | TRP | 13 | −7.722 | −3.057 | 0.618 | 1.00 | 0.00 |
| ATOM | 195 | H | TRP | 13 | −7.749 | −4.043 | 0.453 | 1.00 | 0.00 |
| ATOM | 196 | CA | TRP | 13 | −6.389 | −2.477 | 0.647 | 1.00 | 0.00 |
| ATOM | 197 | HA | TRP | 13 | −6.207 | −2.112 | 1.657 | 1.00 | 0.00 |
| ATOM | 198 | CB | TRP | 13 | −5.323 | −3.535 | 0.356 | 1.00 | 0.00 |
| ATOM | 199 | 2HB | TRP | 13 | −5.118 | −3.544 | −0.715 | 1.00 | 0.00 |
| ATOM | 200 | QB | TRP | 13 | −5.118 | −3.544 | −0.715 | 1.00 | 0.00 |
| ATOM | 201 | CG | TRP | 13 | −4.011 | −3.320 | 1.111 | 1.00 | 0.00 |
| ATOM | 202 | CD1 | TRP | 13 | −3.797 | −2.561 | 2.194 | 1.00 | 0.00 |
| ATOM | 203 | CD2 | TRP | 13 | −2.730 | −3.906 | 0.794 | 1.00 | 0.00 |
| ATOM | 204 | CE3 | TRP | 13 | −2.363 | −4.786 | −0.241 | 1.00 | 0.00 |
| ATOM | 205 | CE2 | TRP | 13 | −1.809 | −3.458 | 1.717 | 1.00 | 0.00 |
| ATOM | 206 | NE1 | TRP | 13 | −2.477 | −2.614 | 2.596 | 1.00 | 0.00 |
| ATOM | 207 | HD | TRP | 13 | −4.568 | −1.975 | 2.694 | 1.00 | 0.00 |
| ATOM | 208 | 3HE | TRP | 13 | −3.072 | −5.153 | −0.982 | 1.00 | 0.00 |
| ATOM | 209 | CZ3 | TRP | 13 | −1.013 | −5.153 | −0.243 | 1.00 | 0.00 |
| ATOM | 210 | CZ2 | TRP | 13 | −0.461 | −3.835 | 1.701 | 1.00 | 0.00 |
| ATOM | 211 | 1HE | TRP | 13 | −2.041 | −2.090 | 3.447 | 1.00 | 0.00 |
| ATOM | 212 | 3HZ | TRP | 13 | −0.674 | −5.834 | −1.025 | 1.00 | 0.00 |
| ATOM | 213 | CH2 | TRP | 13 | −0.072 | −4.711 | 0.679 | 1.00 | 0.00 |
| ATOM | 214 | 2HZ | TRP | 13 | 0.248 | −3.467 | 2.443 | 1.00 | 0.00 |
| ATOM | 215 | HH | TRP | 13 | 0.963 | −5.044 | 0.609 | 1.00 | 0.00 |
| ATOM | 216 | C | TRP | 13 | −6.361 | −1.311 | −0.344 | 1.00 | 0.00 |
| ATOM | 217 | O | TRP | 13 | −5.733 | −0.286 | −0.083 | 1.00 | 0.00 |
| ATOM | 218 | N | ASP− | 14 | −7.047 | −1.506 | −1.459 | 1.00 | 0.00 |
| ATOM | 219 | H | ASP− | 14 | −7.555 | −2.343 | −1.664 | 1.00 | 0.00 |
| ATOM | 220 | CA | ASP− | 14 | −7.108 | −0.484 | −2.490 | 1.00 | 0.00 |
| ATOM | 221 | HA | ASP− | 14 | −6.081 | −0.140 | −2.614 | 1.00 | 0.00 |
| ATOM | 222 | CB | ASP− | 14 | −7.650 | −1.056 | −3.802 | 1.00 | 0.00 |
| ATOM | 223 | 2HB | ASP− | 14 | −7.294 | −2.080 | −3.909 | 1.00 | 0.00 |
| ATOM | 224 | QB | ASP− | 14 | −7.294 | −2.080 | −3.909 | 1.00 | 0.00 |
| ATOM | 225 | CG | ASP− | 14 | −9.175 | −1.053 | −3.926 | 1.00 | 0.00 |
| ATOM | 226 | OD1 | ASP− | 14 | −9.727 | 0.052 | −4.115 | 1.00 | 0.00 |
| ATOM | 227 | OD2 | ASP− | 14 | −9.754 | −2.157 | −3.831 | 1.00 | 0.00 |
| ATOM | 228 | C | ASP− | 14 | −8.049 | 0.635 | −2.037 | 1.00 | 0.00 |
| ATOM | 229 | O | ASP− | 14 | −7.917 | 1.776 | −2.475 | 1.00 | 0.00 |
| ATOM | 230 | N | ILE | 15 | −8.978 | 0.268 | −1.166 | 1.00 | 0.00 |
| ATOM | 231 | H | ILE | 15 | −9.078 | −0.664 | −0.815 | 1.00 | 0.00 |
| ATOM | 232 | CA | ILE | 15 | −9.939 | 1.227 | −0.650 | 1.00 | 0.00 |
| ATOM | 233 | HA | ILE | 15 | −10.258 | 1.851 | −1.484 | 1.00 | 0.00 |
| ATOM | 234 | CB | ILE | 15 | −11.182 | 0.507 | −0.123 | 1.00 | 0.00 |
| ATOM | 235 | HB | ILE | 15 | −11.094 | −0.551 | −0.368 | 1.00 | 0.00 |
| ATOM | 236 | QG2 | ILE | 15 | −11.292 | 0.636 | 1.763 | 1.00 | 0.00 |
| ATOM | 237 | CG2 | ILE | 15 | −11.271 | 0.611 | 1.402 | 1.00 | 0.00 |

TABLE 4-continued

Mistic-L Atomic Structure Coordinates

| ATOM | 238 | 1HG2 | ILE | 15 | −12.198 | 0.152 | 1.744 | 1.00 | 0.00 |
|---|---|---|---|---|---|---|---|---|---|
| ATOM | 239 | 2HG2 | ILE | 15 | −10.423 | 0.096 | 1.851 | 1.00 | 0.00 |
| ATOM | 240 | 3HG2 | ILE | 15 | −11.255 | 1.660 | 1.696 | 1.00 | 0.00 |
| ATOM | 241 | CG1 | ILE | 15 | −12.448 | 1.026 | −0.807 | 1.00 | 0.00 |
| ATOM | 242 | 2HG1 | ILE | 15 | −12.532 | 2.103 | −0.657 | 1.00 | 0.00 |
| ATOM | 243 | QG1 | ILE | 15 | −12.532 | 2.103 | −0.657 | 1.00 | 0.00 |
| ATOM | 244 | QD1 | ILE | 15 | −12.424 | 0.640 | −2.660 | 1.00 | 0.00 |
| ATOM | 245 | CD1 | ILE | 15 | −12.429 | 0.714 | −2.304 | 1.00 | 0.00 |
| ATOM | 246 | 1HD1 | ILE | 15 | −12.643 | 1.622 | −2.867 | 1.00 | 0.00 |
| ATOM | 247 | 2HD1 | ILE | 15 | −11.445 | 0.337 | −2.585 | 1.00 | 0.00 |
| ATOM | 248 | 3HD1 | ILE | 15 | −13.183 | −0.040 | −2.528 | 1.00 | 0.00 |
| ATOM | 249 | C | ILE | 15 | −9.257 | 2.117 | 0.390 | 1.00 | 0.00 |
| ATOM | 250 | O | ILE | 15 | −9.575 | 3.300 | 0.504 | 1.00 | 0.00 |
| ATOM | 251 | N | LEU | 16 | −8.330 | 1.516 | 1.121 | 1.00 | 0.00 |
| ATOM | 252 | H | LEU | 16 | −8.077 | 0.553 | 1.022 | 1.00 | 0.00 |
| ATOM | 253 | CA | LEU | 16 | −7.600 | 2.240 | 2.148 | 1.00 | 0.00 |
| ATOM | 254 | HA | LEU | 16 | −8.310 | 2.893 | 2.655 | 1.00 | 0.00 |
| ATOM | 255 | CB | LEU | 16 | −7.047 | 1.273 | 3.196 | 1.00 | 0.00 |
| ATOM | 256 | 2HB | LEU | 16 | −6.402 | 0.553 | 2.693 | 1.00 | 0.00 |
| ATOM | 257 | QB | LEU | 16 | −6.402 | 0.553 | 2.693 | 1.00 | 0.00 |
| ATOM | 258 | CG | LEU | 16 | −6.259 | 1.906 | 4.344 | 1.00 | 0.00 |
| ATOM | 259 | HG | LEU | 16 | −6.228 | 1.195 | 5.170 | 1.00 | 0.00 |
| ATOM | 260 | QD1 | LEU | 16 | −4.469 | 2.246 | 3.832 | 1.00 | 0.00 |
| ATOM | 261 | QD2 | LEU | 16 | −7.123 | 3.466 | 4.982 | 1.00 | 0.00 |
| ATOM | 262 | CD1 | LEU | 16 | −4.813 | 2.182 | 3.930 | 1.00 | 0.00 |
| ATOM | 263 | 1HD1 | LEU | 16 | −4.135 | 1.745 | 4.665 | 1.00 | 0.00 |
| ATOM | 264 | 2HD1 | LEU | 16 | −4.624 | 1.737 | 2.953 | 1.00 | 0.00 |
| ATOM | 265 | 3HD1 | LEU | 16 | −4.648 | 3.257 | 3.879 | 1.00 | 0.00 |
| ATOM | 266 | CD2 | LEU | 16 | −6.958 | 3.166 | 4.859 | 1.00 | 0.00 |
| ATOM | 267 | 1HD2 | LEU | 16 | −6.982 | 3.916 | 4.069 | 1.00 | 0.00 |
| ATOM | 268 | 2HD2 | LEU | 16 | −7.976 | 2.921 | 5.158 | 1.00 | 0.00 |
| ATOM | 269 | 3HD2 | LEU | 16 | −6.412 | 3.560 | 5.717 | 1.00 | 0.00 |
| ATOM | 270 | QQD | LEU | 16 | −5.796 | 2.856 | 4.407 | 1.00 | 0.00 |
| ATOM | 271 | C | LEU | 16 | −6.528 | 3.110 | 1.488 | 1.00 | 0.00 |
| ATOM | 272 | O | LEU | 16 | −6.174 | 4.167 | 2.008 | 1.00 | 0.00 |
| ATOM | 273 | N | LEU | 17 | −6.042 | 2.632 | 0.352 | 1.00 | 0.00 |
| ATOM | 274 | H | LEU | 17 | −6.335 | 1.771 | −0.065 | 1.00 | 0.00 |
| ATOM | 275 | CA | LEU | 17 | −5.017 | 3.353 | −0.385 | 1.00 | 0.00 |
| ATOM | 276 | HA | LEU | 17 | −4.449 | 3.941 | 0.336 | 1.00 | 0.00 |
| ATOM | 277 | CB | LEU | 17 | −4.041 | 2.375 | −1.040 | 1.00 | 0.00 |
| ATOM | 278 | 2HB | LEU | 17 | −4.609 | 1.530 | −1.430 | 1.00 | 0.00 |
| ATOM | 279 | QB | LEU | 17 | −4.609 | 1.530 | −1.430 | 1.00 | 0.00 |
| ATOM | 280 | CG | LEU | 17 | −3.183 | 2.942 | −2.174 | 1.00 | 0.00 |
| ATOM | 281 | HG | LEU | 17 | −3.113 | 4.021 | −2.043 | 1.00 | 0.00 |
| ATOM | 282 | QD1 | LEU | 17 | −1.422 | 2.252 | −2.103 | 1.00 | 0.00 |
| ATOM | 283 | QD2 | LEU | 17 | −3.996 | 2.636 | −3.857 | 1.00 | 0.00 |
| ATOM | 284 | CD1 | LEU | 17 | −1.760 | 2.385 | −2.117 | 1.00 | 0.00 |
| ATOM | 285 | 1HD1 | LEU | 17 | −1.167 | 2.976 | −1.419 | 1.00 | 0.00 |
| ATOM | 286 | 2HD1 | LEU | 17 | −1.788 | 1.348 | −1.781 | 1.00 | 0.00 |
| ATOM | 287 | 3HD1 | LEU | 17 | −1.310 | 2.433 | −3.108 | 1.00 | 0.00 |
| ATOM | 288 | CD2 | LEU | 17 | −3.841 | 2.694 | −3.535 | 1.00 | 0.00 |
| ATOM | 289 | 1HD2 | LEU | 17 | −3.083 | 2.737 | −4.317 | 1.00 | 0.00 |
| ATOM | 290 | 2HD2 | LEU | 17 | −4.311 | 1.711 | −3.537 | 1.00 | 0.00 |
| ATOM | 291 | 3HD2 | LEU | 17 | −4.595 | 3.459 | −3.717 | 1.00 | 0.00 |
| ATOM | 292 | QQD | LEU | 17 | −2.709 | 2.444 | −2.980 | 1.00 | 0.00 |
| ATOM | 293 | C | LEU | 17 | −5.685 | 4.311 | −1.373 | 1.00 | 0.00 |
| ATOM | 294 | O | LEU | 17 | −5.043 | 5.226 | −1.886 | 1.00 | 0.00 |
| ATOM | 295 | N | GLU− | 18 | −6.965 | 4.067 | −1.612 | 1.00 | 0.00 |
| ATOM | 296 | H | GLU− | 18 | −7.480 | 3.320 | −1.191 | 1.00 | 0.00 |
| ATOM | 297 | CA | GLU− | 18 | −7.726 | 4.897 | −2.530 | 1.00 | 0.00 |
| ATOM | 298 | HA | GLU− | 18 | −6.985 | 5.381 | −3.166 | 1.00 | 0.00 |
| ATOM | 299 | CB | GLU− | 18 | −8.652 | 4.044 | −3.400 | 1.00 | 0.00 |
| ATOM | 300 | 2HB | GLU− | 18 | −9.303 | 3.443 | −2.765 | 1.00 | 0.00 |
| ATOM | 301 | QB | GLU− | 18 | −9.303 | 3.443 | −2.765 | 1.00 | 0.00 |
| ATOM | 302 | CG | GLU− | 18 | −9.502 | 4.923 | −4.321 | 1.00 | 0.00 |
| ATOM | 303 | 2HG | GLU− | 18 | −9.518 | 4.497 | −5.324 | 1.00 | 0.00 |
| ATOM | 304 | QG | GLU− | 18 | −9.518 | 4.497 | −5.324 | 1.00 | 0.00 |
| ATOM | 305 | CD | GLU− | 18 | −10.933 | 5.049 | −3.792 | 1.00 | 0.00 |
| ATOM | 306 | OE1 | GLU− | 18 | −11.322 | 6.194 | −3.475 | 1.00 | 0.00 |
| ATOM | 307 | OE2 | GLU− | 18 | −11.604 | 3.997 | −3.716 | 1.00 | 0.00 |
| ATOM | 308 | C | GLU− | 18 | −8.518 | 5.953 | −1.758 | 1.00 | 0.00 |
| ATOM | 309 | O | GLU− | 18 | −8.975 | 6.938 | −2.336 | 1.00 | 0.00 |
| ATOM | 310 | N | LYS+ | 19 | −8.657 | 5.713 | −0.463 | 1.00 | 0.00 |
| ATOM | 311 | H | LYS+ | 19 | −8.284 | 4.910 | 0.001 | 1.00 | 0.00 |
| ATOM | 312 | CA | LYS+ | 19 | −9.387 | 6.633 | 0.395 | 1.00 | 0.00 |
| ATOM | 313 | HA | LYS+ | 19 | −9.943 | 7.311 | −0.251 | 1.00 | 0.00 |
| ATOM | 314 | CB | LYS+ | 19 | −10.410 | 5.876 | 1.244 | 1.00 | 0.00 |
| ATOM | 315 | 2HB | LYS+ | 19 | −10.815 | 6.539 | 2.009 | 1.00 | 0.00 |

TABLE 4-continued

Mistic-L Atomic Structure Coordinates

| ATOM | 316 | QB | LYS+ | 19 | −10.815 | 6.539 | 2.009 | 1.00 | 0.00 |
|---|---|---|---|---|---|---|---|---|---|
| ATOM | 317 | CG | LYS+ | 19 | −11.548 | 5.333 | 0.377 | 1.00 | 0.00 |
| ATOM | 318 | 2HG | LYS+ | 19 | −11.161 | 4.574 | −0.303 | 1.00 | 0.00 |
| ATOM | 319 | QG | LYS+ | 19 | −11.161 | 4.574 | −0.303 | 1.00 | 0.00 |
| ATOM | 320 | CD | LYS+ | 19 | −12.657 | 4.732 | 1.243 | 1.00 | 0.00 |
| ATOM | 321 | 2HD | LYS+ | 19 | −12.598 | 5.141 | 2.251 | 1.00 | 0.00 |
| ATOM | 322 | QD | LYS+ | 19 | −12.598 | 5.141 | 2.251 | 1.00 | 0.00 |
| ATOM | 323 | CE | LYS+ | 19 | −14.037 | 5.026 | 0.648 | 1.00 | 0.00 |
| ATOM | 324 | 2HE | LYS+ | 19 | −14.024 | 4.833 | −0.426 | 1.00 | 0.00 |
| ATOM | 325 | QE | LYS+ | 19 | −14.024 | 4.833 | −0.426 | 1.00 | 0.00 |
| ATOM | 326 | NZ | LYS+ | 19 | −15.070 | 4.189 | 1.297 | 1.00 | 0.00 |
| ATOM | 327 | 1HZ | LYS+ | 19 | −15.829 | 4.044 | 0.661 | 1.00 | 0.00 |
| ATOM | 328 | 2HZ | LYS+ | 19 | −14.674 | 3.306 | 1.549 | 1.00 | 0.00 |
| ATOM | 329 | 3HZ | LYS+ | 19 | −15.406 | 4.651 | 2.118 | 1.00 | 0.00 |
| ATOM | 330 | QZ | LYS+ | 19 | −15.303 | 4.000 | 1.443 | 1.00 | 0.00 |
| ATOM | 331 | C | LYS+ | 19 | −8.392 | 7.454 | 1.218 | 1.00 | 0.00 |
| ATOM | 332 | O | LYS+ | 19 | −8.620 | 8.634 | 1.475 | 1.00 | 0.00 |
| ATOM | 333 | N | SER | 20 | −7.310 | 6.796 | 1.607 | 1.00 | 0.00 |
| ATOM | 334 | H | SER | 20 | −7.132 | 5.835 | 1.394 | 1.00 | 0.00 |
| ATOM | 335 | CA | SER | 20 | −6.280 | 7.450 | 2.395 | 1.00 | 0.00 |
| ATOM | 336 | HA | SER | 20 | −6.796 | 7.854 | 3.267 | 1.00 | 0.00 |
| ATOM | 337 | CB | SER | 20 | −5.216 | 6.449 | 2.852 | 1.00 | 0.00 |
| ATOM | 338 | 2HB | SER | 20 | −4.818 | 5.923 | 1.985 | 1.00 | 0.00 |
| ATOM | 339 | QB | SER | 20 | −4.818 | 5.923 | 1.985 | 1.00 | 0.00 |
| ATOM | 340 | OG | SER | 20 | −4.150 | 7.085 | 3.552 | 1.00 | 0.00 |
| ATOM | 341 | HG | SER | 20 | −3.293 | 6.600 | 3.382 | 1.00 | 0.00 |
| ATOM | 342 | C | SER | 20 | −5.635 | 8.576 | 1.583 | 1.00 | 0.00 |
| ATOM | 343 | O | SER | 20 | −5.730 | 9.745 | 1.953 | 1.00 | 0.00 |
| ATOM | 344 | N | THR | 21 | −4.994 | 8.183 | 0.493 | 1.00 | 0.00 |
| ATOM | 345 | H | THR | 21 | −4.922 | 7.229 | 0.200 | 1.00 | 0.00 |
| ATOM | 346 | CA | THR | 21 | −4.334 | 9.144 | −0.375 | 1.00 | 0.00 |
| ATOM | 347 | HA | THR | 21 | −4.555 | 10.146 | −0.008 | 1.00 | 0.00 |
| ATOM | 348 | CB | THR | 21 | −2.827 | 8.893 | −0.298 | 1.00 | 0.00 |
| ATOM | 349 | HB | THR | 21 | −2.269 | 9.797 | −0.544 | 1.00 | 0.00 |
| ATOM | 350 | QG2 | THR | 21 | −2.292 | 8.203 | 1.382 | 1.00 | 0.00 |
| ATOM | 351 | OG1 | THR | 21 | −2.608 | 7.813 | −1.201 | 1.00 | 0.00 |
| ATOM | 352 | 1HG | THR | 21 | −3.121 | 7.008 | −0.904 | 1.00 | 0.00 |
| ATOM | 353 | CG2 | THR | 21 | −2.395 | 8.336 | 1.059 | 1.00 | 0.00 |
| ATOM | 354 | 1HG2 | THR | 21 | −2.944 | 8.842 | 1.853 | 1.00 | 0.00 |
| ATOM | 355 | 2HG2 | THR | 21 | −2.605 | 7.266 | 1.098 | 1.00 | 0.00 |
| ATOM | 356 | 3HG2 | THR | 21 | −1.325 | 8.500 | 1.197 | 1.00 | 0.00 |
| ATOM | 357 | C | THR | 21 | −4.894 | 9.052 | −1.796 | 1.00 | 0.00 |
| ATOM | 358 | O | THR | 21 | −4.146 | 9.138 | −2.769 | 1.00 | 0.00 |
| ATOM | 359 | N | GLY | 22 | −6.206 | 8.878 | −1.870 | 1.00 | 0.00 |
| ATOM | 360 | H | GLY | 22 | −6.807 | 8.809 | −1.075 | 1.00 | 0.00 |
| ATOM | 361 | CA | GLY | 22 | −6.874 | 8.773 | −3.156 | 1.00 | 0.00 |
| ATOM | 362 | 1HA | GLY | 22 | −6.165 | 8.987 | −3.957 | 1.00 | 0.00 |
| ATOM | 363 | 2HA | GLY | 22 | −7.226 | 7.753 | −3.306 | 1.00 | 0.00 |
| ATOM | 364 | QA | GLY | 22 | −6.695 | 8.370 | −3.631 | 1.00 | 0.00 |
| ATOM | 365 | C | GLY | 22 | −8.054 | 9.743 | −3.241 | 1.00 | 0.00 |
| ATOM | 366 | O | GLY | 22 | −8.724 | 9.822 | −4.269 | 1.00 | 0.00 |
| ATOM | 367 | N | VAL | 23 | −8.274 | 10.455 | −2.146 | 1.00 | 0.00 |
| ATOM | 368 | H | VAL | 23 | −7.724 | 10.384 | −1.313 | 1.00 | 0.00 |
| ATOM | 369 | CA | VAL | 23 | −9.362 | 11.416 | −2.083 | 1.00 | 0.00 |
| ATOM | 370 | HA | VAL | 23 | −9.794 | 11.489 | −3.081 | 1.00 | 0.00 |
| ATOM | 371 | CB | VAL | 23 | −10.450 | 10.913 | −1.131 | 1.00 | 0.00 |
| ATOM | 372 | HB | VAL | 23 | −11.159 | 11.726 | −0.973 | 1.00 | 0.00 |
| ATOM | 373 | QG1 | VAL | 23 | −11.393 | 9.456 | −1.889 | 1.00 | 0.00 |
| ATOM | 374 | QG2 | VAL | 23 | −9.716 | 10.446 | 0.551 | 1.00 | 0.00 |
| ATOM | 375 | CG1 | VAL | 23 | −11.212 | 9.736 | −1.743 | 1.00 | 0.00 |
| ATOM | 376 | 1HG1 | VAL | 23 | −10.951 | 9.643 | −2.798 | 1.00 | 0.00 |
| ATOM | 377 | 2HG1 | VAL | 23 | −10.944 | 8.818 | −1.221 | 1.00 | 0.00 |
| ATOM | 378 | 3HG1 | VAL | 23 | −12.284 | 9.908 | −1.648 | 1.00 | 0.00 |
| ATOM | 379 | CG2 | VAL | 23 | −9.858 | 10.536 | 0.228 | 1.00 | 0.00 |
| ATOM | 380 | 1HG2 | VAL | 23 | −8.785 | 10.371 | 0.124 | 1.00 | 0.00 |
| ATOM | 381 | 2HG2 | VAL | 23 | −10.033 | 11.344 | 0.938 | 1.00 | 0.00 |
| ATOM | 382 | 3HG2 | VAL | 23 | −10.331 | 9.623 | 0.591 | 1.00 | 0.00 |
| ATOM | 383 | QQG | VAL | 23 | −10.555 | 9.951 | −0.669 | 1.00 | 0.00 |
| ATOM | 384 | C | VAL | 23 | −8.806 | 12.785 | −1.685 | 1.00 | 0.00 |
| ATOM | 385 | O | VAL | 23 | −9.177 | 13.802 | −2.268 | 1.00 | 0.00 |
| ATOM | 386 | N | MET | 24 | −7.926 | 12.766 | −0.695 | 1.00 | 0.00 |
| ATOM | 387 | H | MET | 24 | −7.629 | 11.933 | −0.226 | 1.00 | 0.00 |
| ATOM | 388 | CA | MET | 24 | −7.314 | 13.992 | −0.213 | 1.00 | 0.00 |
| ATOM | 389 | HA | MET | 24 | −6.440 | 13.679 | 0.359 | 1.00 | 0.00 |
| ATOM | 390 | CB | MET | 24 | −6.917 | 14.868 | −1.403 | 1.00 | 0.00 |
| ATOM | 391 | 2HB | MET | 24 | −7.806 | 15.332 | −1.829 | 1.00 | 0.00 |
| ATOM | 392 | QB | MET | 24 | −7.806 | 15.332 | −1.829 | 1.00 | 0.00 |
| ATOM | 393 | CG | MET | 24 | −5.922 | 15.949 | −0.980 | 1.00 | 0.00 |

TABLE 4-continued

Mistic-L Atomic Structure Coordinates

| ATOM | 394 | 2HG | MET | 24 | −4.907 | 15.641 | −1.234 | 1.00 | 0.00 |
|---|---|---|---|---|---|---|---|---|---|
| ATOM | 395 | QG | MET | 24 | −4.907 | 15.641 | −1.234 | 1.00 | 0.00 |
| ATOM | 396 | SD | MET | 24 | −6.311 | 17.490 | −1.793 | 1.00 | 0.00 |
| ATOM | 397 | QE | MET | 24 | −8.181 | 17.951 | −0.840 | 1.00 | 0.00 |
| ATOM | 398 | CE | MET | 24 | −7.865 | 17.873 | −1.002 | 1.00 | 0.00 |
| ATOM | 399 | 1HE | MET | 24 | −8.561 | 17.048 | −1.149 | 1.00 | 0.00 |
| ATOM | 400 | 2HE | MET | 24 | −7.701 | 18.025 | 0.066 | 1.00 | 0.00 |
| ATOM | 401 | 3HE | MET | 24 | −8.280 | 18.781 | −1.438 | 1.00 | 0.00 |
| ATOM | 402 | C | MET | 24 | −8.277 | 14.765 | 0.691 | 1.00 | 0.00 |
| ATOM | 403 | O | MET | 24 | −8.234 | 15.993 | 0.743 | 1.00 | 0.00 |
| ATOM | 404 | N | GLU− | 25 | −9.122 | 14.014 | 1.382 | 1.00 | 0.00 |
| ATOM | 405 | H | GLU− | 25 | −9.150 | 13.016 | 1.334 | 1.00 | 0.00 |
| ATOM | 406 | CA | GLU− | 25 | −10.094 | 14.613 | 2.280 | 1.00 | 0.00 |
| ATOM | 407 | HA | GLU− | 25 | −9.511 | 15.026 | 3.104 | 1.00 | 0.00 |
| ATOM | 408 | CB | GLU− | 25 | −10.855 | 15.746 | 1.589 | 1.00 | 0.00 |
| ATOM | 409 | 2HB | GLU− | 25 | −10.322 | 16.686 | 1.728 | 1.00 | 0.00 |
| ATOM | 410 | QB | GLU− | 25 | −10.322 | 16.686 | 1.728 | 1.00 | 0.00 |
| ATOM | 411 | CG | GLU− | 25 | −11.019 | 15.463 | 0.094 | 1.00 | 0.00 |
| ATOM | 412 | 2HG | GLU− | 25 | −10.867 | 14.402 | −0.098 | 1.00 | 0.00 |
| ATOM | 413 | QG | GLU− | 25 | −10.867 | 14.402 | −0.098 | 1.00 | 0.00 |
| ATOM | 414 | CD | GLU− | 25 | −12.409 | 15.880 | −0.394 | 1.00 | 0.00 |
| ATOM | 415 | OE1 | GLU− | 25 | −12.522 | 17.031 | −0.866 | 1.00 | 0.00 |
| ATOM | 416 | OE2 | GLU− | 25 | −13.326 | 15.038 | −0.282 | 1.00 | 0.00 |
| ATOM | 417 | C | GLU− | 25 | −11.056 | 13.548 | 2.809 | 1.00 | 0.00 |
| ATOM | 418 | O | GLU− | 25 | −11.322 | 13.485 | 4.008 | 1.00 | 0.00 |
| ATOM | 419 | N | ALA | 26 | −11.554 | 12.736 | 1.886 | 1.00 | 0.00 |
| ATOM | 420 | H | ALA | 26 | −11.333 | 12.794 | 0.913 | 1.00 | 0.00 |
| ATOM | 421 | CA | ALA | 26 | −12.481 | 11.676 | 2.245 | 1.00 | 0.00 |
| ATOM | 422 | HA | ALA | 26 | −13.364 | 12.142 | 2.684 | 1.00 | 0.00 |
| ATOM | 423 | QB | ALA | 26 | −13.000 | 10.738 | 0.684 | 1.00 | 0.00 |
| ATOM | 424 | CB | ALA | 26 | −12.901 | 10.918 | 0.984 | 1.00 | 0.00 |
| ATOM | 425 | 1HB | ALA | 26 | −12.246 | 10.058 | 0.842 | 1.00 | 0.00 |
| ATOM | 426 | 2HB | ALA | 26 | −13.930 | 10.577 | 1.090 | 1.00 | 0.00 |
| ATOM | 427 | 3HB | ALA | 26 | −12.824 | 11.579 | 0.120 | 1.00 | 0.00 |
| ATOM | 428 | C | ALA | 26 | −11.829 | 10.763 | 3.284 | 1.00 | 0.00 |
| ATOM | 429 | O | ALA | 26 | −12.513 | 9.990 | 3.953 | 1.00 | 0.00 |
| ATOM | 430 | N | MET | 27 | −10.514 | 10.882 | 3.387 | 1.00 | 0.00 |
| ATOM | 431 | H | MET | 27 | −9.964 | 11.514 | 2.839 | 1.00 | 0.00 |
| ATOM | 432 | CA | MET | 27 | −9.761 | 10.077 | 4.334 | 1.00 | 0.00 |
| ATOM | 433 | HA | MET | 27 | −10.304 | 10.149 | 5.277 | 1.00 | 0.00 |
| ATOM | 434 | CB | MET | 27 | −9.697 | 8.631 | 3.838 | 1.00 | 0.00 |
| ATOM | 435 | 2HB | MET | 27 | −8.664 | 8.363 | 3.620 | 1.00 | 0.00 |
| ATOM | 436 | QB | MET | 27 | −8.664 | 8.363 | 3.620 | 1.00 | 0.00 |
| ATOM | 437 | CG | MET | 27 | −10.270 | 7.668 | 4.879 | 1.00 | 0.00 |
| ATOM | 438 | 2HG | MET | 27 | −10.233 | 6.646 | 4.501 | 1.00 | 0.00 |
| ATOM | 439 | QG | MET | 27 | −10.233 | 6.646 | 4.501 | 1.00 | 0.00 |
| ATOM | 440 | SD | MET | 27 | −9.342 | 7.788 | 6.399 | 1.00 | 0.00 |
| ATOM | 441 | QE | MET | 27 | −10.791 | 8.774 | 7.643 | 1.00 | 0.00 |
| ATOM | 442 | CE | MET | 27 | −10.547 | 8.608 | 7.433 | 1.00 | 0.00 |
| ATOM | 443 | 1HE | MET | 27 | −10.541 | 9.676 | 7.219 | 1.00 | 0.00 |
| ATOM | 444 | 2HE | MET | 27 | −11.537 | 8.200 | 7.229 | 1.00 | 0.00 |
| ATOM | 445 | 3HE | MET | 27 | −10.296 | 8.445 | 8.480 | 1.00 | 0.00 |
| ATOM | 446 | C | MET | 27 | −8.342 | 10.620 | 4.510 | 1.00 | 0.00 |
| ATOM | 447 | O | MET | 27 | −7.439 | 9.889 | 4.913 | 1.00 | 0.00 |
| ATOM | 448 | N | LYS+ | 28 | −8.189 | 11.899 | 4.199 | 1.00 | 0.00 |
| ATOM | 449 | H | LYS+ | 28 | −8.928 | 12.487 | 3.872 | 1.00 | 0.00 |
| ATOM | 450 | CA | LYS+ | 28 | −6.895 | 12.549 | 4.318 | 1.00 | 0.00 |
| ATOM | 451 | HA | LYS+ | 28 | −6.201 | 11.821 | 4.739 | 1.00 | 0.00 |
| ATOM | 452 | CB | LYS+ | 28 | −6.361 | 12.934 | 2.937 | 1.00 | 0.00 |
| ATOM | 453 | 2HB | LYS+ | 28 | −7.191 | 13.049 | 2.240 | 1.00 | 0.00 |
| ATOM | 454 | QB | LYS+ | 28 | −7.191 | 13.049 | 2.240 | 1.00 | 0.00 |
| ATOM | 455 | CG | LYS+ | 28 | −5.561 | 14.238 | 3.002 | 1.00 | 0.00 |
| ATOM | 456 | 2HG | LYS+ | 28 | −4.947 | 14.337 | 2.108 | 1.00 | 0.00 |
| ATOM | 457 | QG | LYS+ | 28 | −4.947 | 14.337 | 2.108 | 1.00 | 0.00 |
| ATOM | 458 | CD | LYS+ | 28 | −6.491 | 15.446 | 3.127 | 1.00 | 0.00 |
| ATOM | 459 | 2HD | LYS+ | 28 | −7.495 | 15.111 | 3.389 | 1.00 | 0.00 |
| ATOM | 460 | QD | LYS+ | 28 | −7.495 | 15.111 | 3.389 | 1.00 | 0.00 |
| ATOM | 461 | CE | LYS+ | 28 | −5.980 | 16.424 | 4.187 | 1.00 | 0.00 |
| ATOM | 462 | 2HE | LYS+ | 28 | −5.031 | 16.071 | 4.590 | 1.00 | 0.00 |
| ATOM | 463 | QE | LYS+ | 28 | −5.031 | 16.071 | 4.590 | 1.00 | 0.00 |
| ATOM | 464 | NZ | LYS+ | 28 | −5.809 | 17.775 | 3.607 | 1.00 | 0.00 |
| ATOM | 465 | 1HZ | LYS+ | 28 | −5.404 | 18.382 | 4.290 | 1.00 | 0.00 |
| ATOM | 466 | 2HZ | LYS+ | 28 | −5.207 | 17.720 | 2.810 | 1.00 | 0.00 |
| ATOM | 467 | 3HZ | LYS+ | 28 | −6.700 | 18.134 | 3.328 | 1.00 | 0.00 |
| ATOM | 468 | QZ | LYS+ | 28 | −5.770 | 18.079 | 3.476 | 1.00 | 0.00 |
| ATOM | 469 | C | LYS+ | 28 | −7.007 | 13.729 | 5.285 | 1.00 | 0.00 |
| ATOM | 470 | O | LYS+ | 28 | −6.000 | 14.322 | 5.667 | 1.00 | 0.00 |
| ATOM | 471 | N | VAL | 29 | −8.243 | 14.034 | 5.654 | 1.00 | 0.00 |

TABLE 4-continued

Mistic-L Atomic Structure Coordinates

| ATOM | 472 | H | VAL | 29 | −9.057 | 13.547 | 5.339 | 1.00 | 0.00 |
|---|---|---|---|---|---|---|---|---|---|
| ATOM | 473 | CA | VAL | 29 | −8.501 | 15.132 | 6.570 | 1.00 | 0.00 |
| ATOM | 474 | HA | VAL | 29 | −7.537 | 15.538 | 6.876 | 1.00 | 0.00 |
| ATOM | 475 | CB | VAL | 29 | −9.275 | 16.240 | 5.853 | 1.00 | 0.00 |
| ATOM | 476 | HB | VAL | 29 | −8.856 | 16.349 | 4.853 | 1.00 | 0.00 |
| ATOM | 477 | QG1 | VAL | 29 | −11.103 | 15.782 | 5.670 | 1.00 | 0.00 |
| ATOM | 478 | QG2 | VAL | 29 | −9.077 | 17.895 | 6.751 | 1.00 | 0.00 |
| ATOM | 479 | CG1 | VAL | 29 | −10.752 | 15.870 | 5.706 | 1.00 | 0.00 |
| ATOM | 480 | 1HG1 | VAL | 29 | −11.126 | 16.241 | 4.751 | 1.00 | 0.00 |
| ATOM | 481 | 2HG1 | VAL | 29 | −10.861 | 14.785 | 5.741 | 1.00 | 0.00 |
| ATOM | 482 | 3HG1 | VAL | 29 | −11.322 | 16.319 | 6.519 | 1.00 | 0.00 |
| ATOM | 483 | CG2 | VAL | 29 | −9.115 | 17.578 | 6.578 | 1.00 | 0.00 |
| ATOM | 484 | 1HG2 | VAL | 29 | −9.103 | 17.408 | 7.655 | 1.00 | 0.00 |
| ATOM | 485 | 2HG2 | VAL | 29 | −8.180 | 18.047 | 6.274 | 1.00 | 0.00 |
| ATOM | 486 | 3HG2 | VAL | 29 | −9.950 | 18.232 | 6.324 | 1.00 | 0.00 |
| ATOM | 487 | QQG | VAL | 29 | −10.090 | 16.839 | 6.211 | 1.00 | 0.00 |
| ATOM | 488 | C | VAL | 29 | −9.227 | 14.600 | 7.807 | 1.00 | 0.00 |
| ATOM | 489 | O | VAL | 29 | −10.295 | 15.093 | 8.165 | 1.00 | 0.00 |
| ATOM | 490 | N | THR | 30 | −8.618 | 13.598 | 8.426 | 1.00 | 0.00 |
| ATOM | 491 | H | THR | 30 | −7.750 | 13.202 | 8.128 | 1.00 | 0.00 |
| ATOM | 492 | CA | THR | 30 | −9.194 | 12.993 | 9.615 | 1.00 | 0.00 |
| ATOM | 493 | HA | THR | 30 | −10.204 | 13.379 | 9.743 | 1.00 | 0.00 |
| ATOM | 494 | CB | THR | 30 | −9.249 | 11.480 | 9.396 | 1.00 | 0.00 |
| ATOM | 495 | HB | THR | 30 | −8.637 | 11.188 | 8.543 | 1.00 | 0.00 |
| ATOM | 496 | QG2 | THR | 30 | −8.761 | 10.505 | 10.944 | 1.00 | 0.00 |
| ATOM | 497 | OG1 | THR | 30 | −10.637 | 11.203 | 9.235 | 1.00 | 0.00 |
| ATOM | 498 | 1HG | THR | 30 | −11.134 | 11.450 | 10.067 | 1.00 | 0.00 |
| ATOM | 499 | CG2 | THR | 30 | −8.854 | 10.692 | 10.646 | 1.00 | 0.00 |
| ATOM | 500 | 1HG2 | THR | 30 | −7.809 | 10.890 | 10.886 | 1.00 | 0.00 |
| ATOM | 501 | 2HG2 | THR | 30 | −9.482 | 10.999 | 11.483 | 1.00 | 0.00 |
| ATOM | 502 | 3HG2 | THR | 30 | −8.990 | 9.626 | 10.463 | 1.00 | 0.00 |
| ATOM | 503 | C | THR | 30 | −8.397 | 13.399 | 10.857 | 1.00 | 0.00 |
| ATOM | 504 | O | THR | 30 | −8.735 | 13.001 | 11.972 | 1.00 | 0.00 |
| ATOM | 505 | N | SER | 31 | −7.357 | 14.184 | 10.624 | 1.00 | 0.00 |
| ATOM | 506 | H | SER | 31 | −7.089 | 14.503 | 9.715 | 1.00 | 0.00 |
| ATOM | 507 | CA | SER | 31 | −6.510 | 14.647 | 11.711 | 1.00 | 0.00 |
| ATOM | 508 | HA | SER | 31 | −6.890 | 15.636 | 11.970 | 1.00 | 0.00 |
| ATOM | 509 | CB | SER | 31 | −6.619 | 13.724 | 12.926 | 1.00 | 0.00 |
| ATOM | 510 | 2HB | SER | 31 | −6.704 | 12.691 | 12.589 | 1.00 | 0.00 |
| ATOM | 511 | QB | SER | 31 | −6.704 | 12.691 | 12.589 | 1.00 | 0.00 |
| ATOM | 512 | OG | SER | 31 | −5.496 | 13.849 | 13.793 | 1.00 | 0.00 |
| ATOM | 513 | HG | SER | 31 | −5.579 | 14.681 | 14.343 | 1.00 | 0.00 |
| ATOM | 514 | C | SER | 31 | −5.057 | 14.737 | 11.240 | 1.00 | 0.00 |
| ATOM | 515 | O | SER | 31 | −4.222 | 15.347 | 11.906 | 1.00 | 0.00 |
| ATOM | 516 | N | GLU− | 32 | −4.799 | 14.120 | 10.096 | 1.00 | 0.00 |
| ATOM | 517 | H | GLU− | 32 | −5.484 | 13.626 | 9.561 | 1.00 | 0.00 |
| ATOM | 518 | CA | GLU− | 32 | −3.462 | 14.122 | 9.529 | 1.00 | 0.00 |
| ATOM | 519 | HA | GLU− | 32 | −3.595 | 13.893 | 8.473 | 1.00 | 0.00 |
| ATOM | 520 | CB | GLU− | 32 | −2.812 | 15.501 | 9.665 | 1.00 | 0.00 |
| ATOM | 521 | 2HB | GLU− | 32 | −2.072 | 15.481 | 10.465 | 1.00 | 0.00 |
| ATOM | 522 | QB | GLU− | 32 | −2.072 | 15.481 | 10.465 | 1.00 | 0.00 |
| ATOM | 523 | CG | GLU− | 32 | −2.142 | 15.922 | 8.356 | 1.00 | 0.00 |
| ATOM | 524 | 2HG | GLU− | 32 | −1.935 | 15.041 | 7.748 | 1.00 | 0.00 |
| ATOM | 525 | QG | GLU− | 32 | −1.935 | 15.041 | 7.748 | 1.00 | 0.00 |
| ATOM | 526 | CD | GLU− | 32 | −3.031 | 16.891 | 7.572 | 1.00 | 0.00 |
| ATOM | 527 | OE1 | GLU− | 32 | −3.837 | 16.388 | 6.759 | 1.00 | 0.00 |
| ATOM | 528 | OE2 | GLU− | 32 | −2.885 | 18.109 | 7.804 | 1.00 | 0.00 |
| ATOM | 529 | C | GLU− | 32 | −2.603 | 13.043 | 10.191 | 1.00 | 0.00 |
| ATOM | 530 | O | GLU− | 32 | −2.259 | 12.045 | 9.560 | 1.00 | 0.00 |
| ATOM | 531 | N | GLU− | 33 | −2.281 | 13.280 | 11.455 | 1.00 | 0.00 |
| ATOM | 532 | H | GLU− | 33 | −2.565 | 14.094 | 11.960 | 1.00 | 0.00 |
| ATOM | 533 | CA | GLU− | 33 | −1.469 | 12.340 | 12.209 | 1.00 | 0.00 |
| ATOM | 534 | HA | GLU− | 33 | −0.617 | 12.113 | 11.567 | 1.00 | 0.00 |
| ATOM | 535 | CB | GLU− | 33 | −0.963 | 12.972 | 13.507 | 1.00 | 0.00 |
| ATOM | 536 | 2HB | GLU− | 33 | −0.966 | 12.228 | 14.303 | 1.00 | 0.00 |
| ATOM | 537 | QB | GLU− | 33 | −0.966 | 12.228 | 14.303 | 1.00 | 0.00 |
| ATOM | 538 | CG | GLU− | 33 | 0.449 | 13.532 | 13.331 | 1.00 | 0.00 |
| ATOM | 539 | 2HG | GLU− | 33 | 0.403 | 14.492 | 12.816 | 1.00 | 0.00 |
| ATOM | 540 | QG | GLU− | 33 | 0.403 | 14.492 | 12.816 | 1.00 | 0.00 |
| ATOM | 541 | CD | GLU− | 33 | 1.144 | 13.705 | 14.683 | 1.00 | 0.00 |
| ATOM | 542 | OE1 | GLU− | 33 | 0.412 | 13.932 | 15.672 | 1.00 | 0.00 |
| ATOM | 543 | OE2 | GLU− | 33 | 2.390 | 13.607 | 14.699 | 1.00 | 0.00 |
| ATOM | 544 | C | GLU− | 33 | −2.260 | 11.063 | 12.492 | 1.00 | 0.00 |
| ATOM | 545 | O | GLU− | 33 | −1.695 | 9.970 | 12.520 | 1.00 | 0.00 |
| ATOM | 546 | N | LYS+ | 34 | −3.558 | 11.241 | 12.697 | 1.00 | 0.00 |
| ATOM | 547 | H | LYS+ | 34 | −4.010 | 12.132 | 12.673 | 1.00 | 0.00 |
| ATOM | 548 | CA | LYS+ | 34 | −4.433 | 10.116 | 12.977 | 1.00 | 0.00 |
| ATOM | 549 | HA | LYS+ | 34 | −3.822 | 9.331 | 13.423 | 1.00 | 0.00 |

TABLE 4-continued

Mistic-L Atomic Structure Coordinates

| ATOM | 550 | CB | LYS+ | 34 | −5.492 | 10.506 | 14.010 | 1.00 | 0.00 |
| ATOM | 551 | 2HB | LYS+ | 34 | −6.443 | 10.039 | 13.755 | 1.00 | 0.00 |
| ATOM | 552 | QB | LYS+ | 34 | −6.443 | 10.039 | 13.755 | 1.00 | 0.00 |
| ATOM | 553 | CG | LYS+ | 34 | −5.069 | 10.078 | 15.417 | 1.00 | 0.00 |
| ATOM | 554 | 2HG | LYS+ | 34 | −4.753 | 10.952 | 15.987 | 1.00 | 0.00 |
| ATOM | 555 | QG | LYS+ | 34 | −4.753 | 10.952 | 15.987 | 1.00 | 0.00 |
| ATOM | 556 | CD | LYS+ | 34 | −6.218 | 9.377 | 16.145 | 1.00 | 0.00 |
| ATOM | 557 | 2HD | LYS+ | 34 | −6.400 | 8.403 | 15.691 | 1.00 | 0.00 |
| ATOM | 558 | QD | LYS+ | 34 | −6.400 | 8.403 | 15.691 | 1.00 | 0.00 |
| ATOM | 559 | CE | LYS+ | 34 | −5.898 | 9.201 | 17.631 | 1.00 | 0.00 |
| ATOM | 560 | 2HE | LYS+ | 34 | −6.535 | 9.854 | 18.227 | 1.00 | 0.00 |
| ATOM | 561 | QE | LYS+ | 34 | −6.535 | 9.854 | 18.227 | 1.00 | 0.00 |
| ATOM | 562 | NZ | LYS+ | 34 | −6.101 | 7.793 | 18.042 | 1.00 | 0.00 |
| ATOM | 563 | 1HZ | LYS+ | 34 | −5.213 | 7.347 | 18.151 | 1.00 | 0.00 |
| ATOM | 564 | 2HZ | LYS+ | 34 | −6.597 | 7.766 | 18.909 | 1.00 | 0.00 |
| ATOM | 565 | 3HZ | LYS+ | 34 | −6.630 | 7.314 | 17.341 | 1.00 | 0.00 |
| ATOM | 566 | QZ | LYS+ | 34 | −6.147 | 7.476 | 18.134 | 1.00 | 0.00 |
| ATOM | 567 | C | LYS+ | 34 | −5.018 | 9.590 | 11.665 | 1.00 | 0.00 |
| ATOM | 568 | O | LYS+ | 34 | −5.445 | 8.440 | 11.588 | 1.00 | 0.00 |
| ATOM | 569 | N | GLU− | 35 | −5.019 | 10.460 | 10.665 | 1.00 | 0.00 |
| ATOM | 570 | H | GLU− | 35 | −4.670 | 11.394 | 10.735 | 1.00 | 0.00 |
| ATOM | 571 | CA | GLU− | 35 | −5.544 | 10.097 | 9.359 | 1.00 | 0.00 |
| ATOM | 572 | HA | GLU− | 35 | −6.438 | 9.506 | 9.561 | 1.00 | 0.00 |
| ATOM | 573 | CB | GLU− | 35 | −5.938 | 11.343 | 8.563 | 1.00 | 0.00 |
| ATOM | 574 | 2HB | GLU− | 35 | −5.140 | 12.084 | 8.621 | 1.00 | 0.00 |
| ATOM | 575 | QB | GLU− | 35 | −5.140 | 12.084 | 8.621 | 1.00 | 0.00 |
| ATOM | 576 | CG | GLU− | 35 | −6.209 | 10.993 | 7.098 | 1.00 | 0.00 |
| ATOM | 577 | 2HG | GLU− | 35 | −6.785 | 11.791 | 6.630 | 1.00 | 0.00 |
| ATOM | 578 | QG | GLU− | 35 | −6.785 | 11.791 | 6.630 | 1.00 | 0.00 |
| ATOM | 579 | CD | GLU− | 35 | −4.900 | 10.787 | 6.332 | 1.00 | 0.00 |
| ATOM | 580 | OE1 | GLU− | 35 | −3.870 | 11.306 | 6.817 | 1.00 | 0.00 |
| ATOM | 581 | OE2 | GLU− | 35 | −4.957 | 10.115 | 5.280 | 1.00 | 0.00 |
| ATOM | 582 | C | GLU− | 35 | −4.524 | 9.255 | 8.592 | 1.00 | 0.00 |
| ATOM | 583 | O | GLU− | 35 | −4.867 | 8.609 | 7.602 | 1.00 | 0.00 |
| ATOM | 584 | N | GLN | 36 | −3.292 | 9.287 | 9.078 | 1.00 | 0.00 |
| ATOM | 585 | H | GLN | 36 | −3.023 | 9.815 | 9.883 | 1.00 | 0.00 |
| ATOM | 586 | CA | GLN | 36 | −2.221 | 8.534 | 8.449 | 1.00 | 0.00 |
| ATOM | 587 | HA | GLN | 36 | −2.624 | 8.197 | 7.495 | 1.00 | 0.00 |
| ATOM | 588 | CB | GLN | 36 | −1.002 | 9.423 | 8.192 | 1.00 | 0.00 |
| ATOM | 589 | 2HB | GLN | 36 | −0.286 | 9.311 | 9.006 | 1.00 | 0.00 |
| ATOM | 590 | QB | GLN | 36 | −0.286 | 9.311 | 9.006 | 1.00 | 0.00 |
| ATOM | 591 | CG | GLN | 36 | −0.333 | 9.066 | 6.864 | 1.00 | 0.00 |
| ATOM | 592 | 2HG | GLN | 36 | 0.225 | 8.136 | 6.972 | 1.00 | 0.00 |
| ATOM | 593 | QG | GLN | 36 | 0.225 | 8.136 | 6.972 | 1.00 | 0.00 |
| ATOM | 594 | CD | GLN | 36 | −1.371 | 8.919 | 5.749 | 1.00 | 0.00 |
| ATOM | 595 | OE1 | GLN | 36 | −1.469 | 7.898 | 5.088 | 1.00 | 0.00 |
| ATOM | 596 | NE2 | GLN | 36 | −2.139 | 9.991 | 5.579 | 1.00 | 0.00 |
| ATOM | 597 | 1HE2 | GLN | 36 | −2.007 | 10.797 | 6.156 | 1.00 | 0.00 |
| ATOM | 598 | 2HE2 | GLN | 36 | −2.848 | 9.992 | 4.874 | 1.00 | 0.00 |
| ATOM | 599 | QE2 | GLN | 36 | −2.428 | 10.394 | 5.515 | 1.00 | 0.00 |
| ATOM | 600 | C | GLN | 36 | −1.845 | 7.326 | 9.311 | 1.00 | 0.00 |
| ATOM | 601 | O | GLN | 36 | −1.531 | 6.258 | 8.786 | 1.00 | 0.00 |
| ATOM | 602 | N | LEU | 37 | −1.888 | 7.535 | 10.618 | 1.00 | 0.00 |
| ATOM | 603 | H | LEU | 37 | −2.145 | 8.406 | 11.036 | 1.00 | 0.00 |
| ATOM | 604 | CA | LEU | 37 | −1.557 | 6.477 | 11.557 | 1.00 | 0.00 |
| ATOM | 605 | HA | LEU | 37 | −0.727 | 5.912 | 11.132 | 1.00 | 0.00 |
| ATOM | 606 | CB | LEU | 37 | −1.072 | 7.069 | 12.882 | 1.00 | 0.00 |
| ATOM | 607 | 2HB | LEU | 37 | −1.659 | 7.963 | 13.094 | 1.00 | 0.00 |
| ATOM | 608 | QB | LEU | 37 | −1.659 | 7.963 | 13.094 | 1.00 | 0.00 |
| ATOM | 609 | CG | LEU | 37 | −1.147 | 6.143 | 14.097 | 1.00 | 0.00 |
| ATOM | 610 | HG | LEU | 37 | −2.178 | 5.805 | 14.207 | 1.00 | 0.00 |
| ATOM | 611 | QD1 | LEU | 37 | −0.078 | 4.601 | 13.843 | 1.00 | 0.00 |
| ATOM | 612 | QD2 | LEU | 37 | −0.690 | 7.068 | 15.685 | 1.00 | 0.00 |
| ATOM | 613 | CD1 | LEU | 37 | −0.283 | 4.897 | 13.891 | 1.00 | 0.00 |
| ATOM | 614 | 1HD1 | LEU | 37 | 0.665 | 5.021 | 14.415 | 1.00 | 0.00 |
| ATOM | 615 | 2HD1 | LEU | 37 | −0.804 | 4.024 | 14.286 | 1.00 | 0.00 |
| ATOM | 616 | 3HD1 | LEU | 37 | −0.095 | 4.756 | 12.828 | 1.00 | 0.00 |
| ATOM | 617 | CD2 | LEU | 37 | −0.778 | 6.891 | 15.381 | 1.00 | 0.00 |
| ATOM | 618 | 1HD2 | LEU | 37 | −0.717 | 6.185 | 16.208 | 1.00 | 0.00 |
| ATOM | 619 | 2HD2 | LEU | 37 | 0.188 | 7.381 | 15.250 | 1.00 | 0.00 |
| ATOM | 620 | 3HD2 | LEU | 37 | −1.540 | 7.640 | 15.596 | 1.00 | 0.00 |
| ATOM | 621 | QQD | LEU | 37 | −0.384 | 5.835 | 14.764 | 1.00 | 0.00 |
| ATOM | 622 | C | LEU | 37 | −2.756 | 5.539 | 11.705 | 1.00 | 0.00 |
| ATOM | 623 | O | LEU | 37 | −2.644 | 4.338 | 11.460 | 1.00 | 0.00 |
| ATOM | 624 | N | SER | 38 | −3.877 | 6.121 | 12.106 | 1.00 | 0.00 |
| ATOM | 625 | H | SER | 38 | −3.960 | 7.097 | 12.304 | 1.00 | 0.00 |
| ATOM | 626 | CA | SER | 38 | −5.096 | 5.351 | 12.290 | 1.00 | 0.00 |
| ATOM | 627 | HA | SER | 38 | −4.878 | 4.654 | 13.099 | 1.00 | 0.00 |

TABLE 4-continued

Mistic-L Atomic Structure Coordinates

| ATOM | 628 | CB | SER | 38 | −6.261 | 6.255 | 12.695 | 1.00 | 0.00 |
|---|---|---|---|---|---|---|---|---|---|
| ATOM | 629 | 2HB | SER | 38 | −7.049 | 5.651 | 13.146 | 1.00 | 0.00 |
| ATOM | 630 | QB | SER | 38 | −7.049 | 5.651 | 13.146 | 1.00 | 0.00 |
| ATOM | 631 | OG | SER | 38 | −5.858 | 7.268 | 13.613 | 1.00 | 0.00 |
| ATOM | 632 | HG | SER | 38 | −6.101 | 8.170 | 13.256 | 1.00 | 0.00 |
| ATOM | 633 | C | SER | 38 | −5.435 | 4.593 | 11.005 | 1.00 | 0.00 |
| ATOM | 634 | O | SER | 38 | −6.016 | 3.510 | 11.054 | 1.00 | 0.00 |
| ATOM | 635 | N | THR | 39 | −5.056 | 5.191 | 9.885 | 1.00 | 0.00 |
| ATOM | 636 | H | THR | 39 | −4.585 | 6.072 | 9.853 | 1.00 | 0.00 |
| ATOM | 637 | CA | THR | 39 | −5.314 | 4.586 | 8.590 | 1.00 | 0.00 |
| ATOM | 638 | HA | THR | 39 | −6.212 | 3.975 | 8.668 | 1.00 | 0.00 |
| ATOM | 639 | CB | THR | 39 | −5.547 | 5.711 | 7.580 | 1.00 | 0.00 |
| ATOM | 640 | HB | THR | 39 | −5.916 | 5.315 | 6.634 | 1.00 | 0.00 |
| ATOM | 641 | QG2 | THR | 39 | −6.701 | 7.055 | 8.246 | 1.00 | 0.00 |
| ATOM | 642 | OG1 | THR | 39 | −4.281 | 6.358 | 7.482 | 1.00 | 0.00 |
| ATOM | 643 | 1HG | THR | 39 | −4.140 | 6.955 | 8.272 | 1.00 | 0.00 |
| ATOM | 644 | CG2 | THR | 39 | −6.480 | 6.798 | 8.118 | 1.00 | 0.00 |
| ATOM | 645 | 1HG2 | THR | 39 | −5.989 | 7.324 | 8.936 | 1.00 | 0.00 |
| ATOM | 646 | 2HG2 | THR | 39 | −6.715 | 7.502 | 7.321 | 1.00 | 0.00 |
| ATOM | 647 | 3HG2 | THR | 39 | −7.399 | 6.339 | 8.481 | 1.00 | 0.00 |
| ATOM | 648 | C | THR | 39 | −4.167 | 3.649 | 8.203 | 1.00 | 0.00 |
| ATOM | 649 | O | THR | 39 | −4.344 | 2.753 | 7.379 | 1.00 | 0.00 |
| ATOM | 650 | N | ALA | 40 | −3.017 | 3.890 | 8.814 | 1.00 | 0.00 |
| ATOM | 651 | H | ALA | 40 | −2.881 | 4.621 | 9.482 | 1.00 | 0.00 |
| ATOM | 652 | CA | ALA | 40 | −1.841 | 3.079 | 8.544 | 1.00 | 0.00 |
| ATOM | 653 | HA | ALA | 40 | −1.860 | 2.810 | 7.488 | 1.00 | 0.00 |
| ATOM | 654 | QB | ALA | 40 | −0.281 | 4.095 | 8.887 | 1.00 | 0.00 |
| ATOM | 655 | CB | ALA | 40 | −0.580 | 3.900 | 8.821 | 1.00 | 0.00 |
| ATOM | 656 | 1HB | ALA | 40 | −0.716 | 4.477 | 9.736 | 1.00 | 0.00 |
| ATOM | 657 | 2HB | ALA | 40 | 0.271 | 3.229 | 8.937 | 1.00 | 0.00 |
| ATOM | 658 | 3HB | ALA | 40 | −0.398 | 4.578 | 7.987 | 1.00 | 0.00 |
| ATOM | 659 | C | ALA | 40 | −1.903 | 1.803 | 9.384 | 1.00 | 0.00 |
| ATOM | 660 | O | ALA | 40 | −1.138 | 0.868 | 9.156 | 1.00 | 0.00 |
| ATOM | 661 | N | ILE | 41 | −2.822 | 1.805 | 10.339 | 1.00 | 0.00 |
| ATOM | 662 | H | ILE | 41 | −3.441 | 2.570 | 10.518 | 1.00 | 0.00 |
| ATOM | 663 | CA | ILE | 41 | −2.993 | 0.658 | 11.216 | 1.00 | 0.00 |
| ATOM | 664 | HA | ILE | 41 | −2.317 | −0.123 | 10.867 | 1.00 | 0.00 |
| ATOM | 665 | CB | ILE | 41 | −2.578 | 1.010 | 12.646 | 1.00 | 0.00 |
| ATOM | 666 | HB | ILE | 41 | −2.902 | 0.205 | 13.304 | 1.00 | 0.00 |
| ATOM | 667 | QG2 | ILE | 41 | −0.695 | 1.132 | 12.796 | 1.00 | 0.00 |
| ATOM | 668 | CG2 | ILE | 41 | −1.056 | 1.108 | 12.767 | 1.00 | 0.00 |
| ATOM | 669 | 1HG2 | ILE | 41 | −0.697 | 0.344 | 13.456 | 1.00 | 0.00 |
| ATOM | 670 | 2HG2 | ILE | 41 | −0.603 | 0.956 | 11.788 | 1.00 | 0.00 |
| ATOM | 671 | 3HG2 | ILE | 41 | −0.784 | 2.094 | 13.144 | 1.00 | 0.00 |
| ATOM | 672 | CG1 | ILE | 41 | −3.274 | 2.288 | 13.120 | 1.00 | 0.00 |
| ATOM | 673 | 2HG1 | ILE | 41 | −3.985 | 2.621 | 12.364 | 1.00 | 0.00 |
| ATOM | 674 | QG1 | ILE | 41 | −3.985 | 2.621 | 12.364 | 1.00 | 0.00 |
| ATOM | 675 | QD1 | ILE | 41 | −4.174 | 2.001 | 14.761 | 1.00 | 0.00 |
| ATOM | 676 | CD1 | ILE | 41 | −4.001 | 2.056 | 14.447 | 1.00 | 0.00 |
| ATOM | 677 | 1HD1 | ILE | 41 | −4.806 | 2.784 | 14.552 | 1.00 | 0.00 |
| ATOM | 678 | 2HD1 | ILE | 41 | −4.418 | 1.049 | 14.461 | 1.00 | 0.00 |
| ATOM | 679 | 3HD1 | ILE | 41 | −3.298 | 2.170 | 15.271 | 1.00 | 0.00 |
| ATOM | 680 | C | ILE | 41 | −4.430 | 0.145 | 11.101 | 1.00 | 0.00 |
| ATOM | 681 | O | ILE | 41 | −4.678 | −1.051 | 11.248 | 1.00 | 0.00 |
| ATOM | 682 | N | ASP− | 42 | −5.337 | 1.074 | 10.841 | 1.00 | 0.00 |
| ATOM | 683 | H | ASP− | 42 | −5.126 | 2.044 | 10.723 | 1.00 | 0.00 |
| ATOM | 684 | CA | ASP− | 42 | −6.743 | 0.730 | 10.704 | 1.00 | 0.00 |
| ATOM | 685 | HA | ASP− | 42 | −7.123 | 0.675 | 11.724 | 1.00 | 0.00 |
| ATOM | 686 | CB | ASP− | 42 | −7.494 | 1.793 | 9.900 | 1.00 | 0.00 |
| ATOM | 687 | 2HB | ASP− | 42 | −8.109 | 1.294 | 9.152 | 1.00 | 0.00 |
| ATOM | 688 | QB | ASP− | 42 | −8.109 | 1.294 | 9.152 | 1.00 | 0.00 |
| ATOM | 689 | CG | ASP− | 42 | −8.388 | 2.718 | 10.730 | 1.00 | 0.00 |
| ATOM | 690 | OD1 | ASP− | 42 | −8.504 | 2.454 | 11.946 | 1.00 | 0.00 |
| ATOM | 691 | OD2 | ASP− | 42 | −8.934 | 3.668 | 10.128 | 1.00 | 0.00 |
| ATOM | 692 | C | ASP− | 42 | −6.867 | −0.601 | 9.959 | 1.00 | 0.00 |
| ATOM | 693 | O | ASP− | 42 | −7.223 | −1.618 | 10.554 | 1.00 | 0.00 |
| ATOM | 694 | N | ARG+ | 43 | −6.569 | −0.552 | 8.670 | 1.00 | 0.00 |
| ATOM | 695 | H | ARG+ | 43 | −6.280 | 0.280 | 8.194 | 1.00 | 0.00 |
| ATOM | 696 | CA | ARG+ | 43 | −6.643 | −1.740 | 7.839 | 1.00 | 0.00 |
| ATOM | 697 | HA | ARG+ | 43 | −7.145 | −2.484 | 8.458 | 1.00 | 0.00 |
| ATOM | 698 | CB | ARG+ | 43 | −7.453 | −1.476 | 6.568 | 1.00 | 0.00 |
| ATOM | 699 | 2HB | ARG+ | 43 | −7.187 | −2.204 | 5.803 | 1.00 | 0.00 |
| ATOM | 700 | QB | ARG+ | 43 | −7.187 | −2.204 | 5.803 | 1.00 | 0.00 |
| ATOM | 701 | CG | ARG+ | 43 | −8.955 | −1.549 | 6.851 | 1.00 | 0.00 |
| ATOM | 702 | 2HG | ARG+ | 43 | −9.126 | −1.578 | 7.926 | 1.00 | 0.00 |
| ATOM | 703 | QG | ARG+ | 43 | −9.126 | −1.578 | 7.926 | 1.00 | 0.00 |
| ATOM | 704 | CD | ARG+ | 43 | −9.686 | −0.349 | 6.245 | 1.00 | 0.00 |
| ATOM | 705 | 2HD | ARG+ | 43 | −10.424 | −0.691 | 5.519 | 1.00 | 0.00 |

TABLE 4-continued

Mistic-L Atomic Structure Coordinates

| ATOM | 706 | QD | ARG+ | 43 | −10.424 | −0.691 | 5.519 | 1.00 | 0.00 |
|---|---|---|---|---|---|---|---|---|---|
| ATOM | 707 | NE | ARG+ | 43 | −10.352 | 0.429 | 7.313 | 1.00 | 0.00 |
| ATOM | 708 | HE | ARG+ | 43 | −9.998 | 1.340 | 7.520 | 1.00 | 0.00 |
| ATOM | 709 | CZ | ARG+ | 43 | −11.401 | −0.012 | 8.021 | 1.00 | 0.00 |
| ATOM | 710 | NH1 | ARG+ | 43 | −11.942 | 0.763 | 8.972 | 1.00 | 0.00 |
| ATOM | 711 | 1HH1 | ARG+ | 43 | −12.724 | 0.434 | 9.500 | 1.00 | 0.00 |
| ATOM | 712 | 2HH1 | ARG+ | 43 | −11.562 | 1.670 | 9.153 | 1.00 | 0.00 |
| ATOM | 713 | QH1 | ARG+ | 43 | −12.143 | 1.052 | 9.327 | 1.00 | 0.00 |
| ATOM | 714 | NH2 | ARG+ | 43 | −11.910 | −1.228 | 7.778 | 1.00 | 0.00 |
| ATOM | 715 | 1HH2 | ARG+ | 43 | −12.693 | −1.557 | 8.307 | 1.00 | 0.00 |
| ATOM | 716 | 2HH2 | ARG+ | 43 | −11.507 | −1.806 | 7.069 | 1.00 | 0.00 |
| ATOM | 717 | QH2 | ARG+ | 43 | −12.100 | −1.682 | 7.688 | 1.00 | 0.00 |
| ATOM | 718 | C | ARG+ | 43 | −5.237 | −2.207 | 7.451 | 1.00 | 0.00 |
| ATOM | 719 | O | ARG+ | 43 | −5.004 | −3.400 | 7.267 | 1.00 | 0.00 |
| ATOM | 720 | N | MET | 44 | −4.339 | −1.240 | 7.338 | 1.00 | 0.00 |
| ATOM | 721 | H | MET | 44 | −4.537 | −0.271 | 7.489 | 1.00 | 0.00 |
| ATOM | 722 | CA | MET | 44 | −2.963 | −1.536 | 6.975 | 1.00 | 0.00 |
| ATOM | 723 | HA | MET | 44 | −3.014 | −2.013 | 5.997 | 1.00 | 0.00 |
| ATOM | 724 | CB | MET | 44 | −2.159 | −0.234 | 6.919 | 1.00 | 0.00 |
| ATOM | 725 | 2HB | MET | 44 | −1.148 | −0.412 | 7.286 | 1.00 | 0.00 |
| ATOM | 726 | QB | MET | 44 | −1.148 | −0.412 | 7.286 | 1.00 | 0.00 |
| ATOM | 727 | CG | MET | 44 | −2.101 | 0.312 | 5.492 | 1.00 | 0.00 |
| ATOM | 728 | 2HG | MET | 44 | −2.040 | 1.400 | 5.513 | 1.00 | 0.00 |
| ATOM | 729 | QG | MET | 44 | −2.040 | 1.400 | 5.513 | 1.00 | 0.00 |
| ATOM | 730 | SD | MET | 44 | −0.684 | −0.359 | 4.639 | 1.00 | 0.00 |
| ATOM | 731 | QE | MET | 44 | −1.094 | 0.321 | 2.642 | 1.00 | 0.00 |
| ATOM | 732 | CE | MET | 44 | −1.024 | 0.206 | 2.980 | 1.00 | 0.00 |
| ATOM | 733 | 1HE | MET | 44 | −0.153 | 0.732 | 2.590 | 1.00 | 0.00 |
| ATOM | 734 | 2HE | MET | 44 | −1.248 | −0.649 | 2.343 | 1.00 | 0.00 |
| ATOM | 735 | 3HE | MET | 44 | −1.880 | 0.881 | 2.994 | 1.00 | 0.00 |
| ATOM | 736 | C | MET | 44 | −2.323 | −2.489 | 7.986 | 1.00 | 0.00 |
| ATOM | 737 | O | MET | 44 | −1.369 | −3.195 | 7.661 | 1.00 | 0.00 |
| ATOM | 738 | N | ASN | 45 | −2.873 | −2.478 | 9.191 | 1.00 | 0.00 |
| ATOM | 739 | H | ASN | 45 | −3.648 | −1.901 | 9.447 | 1.00 | 0.00 |
| ATOM | 740 | CA | ASN | 45 | −2.367 | −3.334 | 10.252 | 1.00 | 0.00 |
| ATOM | 741 | HA | ASN | 45 | −1.339 | −3.008 | 10.417 | 1.00 | 0.00 |
| ATOM | 742 | CB | ASN | 45 | −3.196 | −3.177 | 11.529 | 1.00 | 0.00 |
| ATOM | 743 | 2HB | ASN | 45 | −4.257 | −3.179 | 11.280 | 1.00 | 0.00 |
| ATOM | 744 | QB | ASN | 45 | −4.257 | −3.179 | 11.280 | 1.00 | 0.00 |
| ATOM | 745 | CG | ASN | 45 | −2.898 | −4.306 | 12.517 | 1.00 | 0.00 |
| ATOM | 746 | OD1 | ASN | 45 | −1.785 | −4.476 | 12.988 | 1.00 | 0.00 |
| ATOM | 747 | ND2 | ASN | 45 | −3.951 | −5.066 | 12.805 | 1.00 | 0.00 |
| ATOM | 748 | 1HD2 | ASN | 45 | −4.837 | −4.872 | 12.384 | 1.00 | 0.00 |
| ATOM | 749 | 2HD2 | ASN | 45 | −3.857 | −5.830 | 13.443 | 1.00 | 0.00 |
| ATOM | 750 | QD2 | ASN | 45 | −4.347 | −5.351 | 12.913 | 1.00 | 0.00 |
| ATOM | 751 | C | ASN | 45 | −2.454 | −4.795 | 9.808 | 1.00 | 0.00 |
| ATOM | 752 | O | ASN | 45 | −1.497 | −5.340 | 9.261 | 1.00 | 0.00 |
| ATOM | 753 | N | GLU− | 46 | −3.612 | −5.389 | 10.059 | 1.00 | 0.00 |
| ATOM | 754 | H | GLU− | 46 | −4.385 | −4.939 | 10.505 | 1.00 | 0.00 |
| ATOM | 755 | CA | GLU− | 46 | −3.837 | −6.777 | 9.692 | 1.00 | 0.00 |
| ATOM | 756 | HA | GLU− | 46 | −2.883 | −7.279 | 9.860 | 1.00 | 0.00 |
| ATOM | 757 | CB | GLU− | 46 | −4.902 | −7.415 | 10.586 | 1.00 | 0.00 |
| ATOM | 758 | 2HB | GLU− | 46 | −5.892 | −7.084 | 10.270 | 1.00 | 0.00 |
| ATOM | 759 | QB | GLU− | 46 | −5.892 | −7.084 | 10.270 | 1.00 | 0.00 |
| ATOM | 760 | CG | GLU− | 46 | −4.827 | −8.942 | 10.525 | 1.00 | 0.00 |
| ATOM | 761 | 2HG | GLU− | 46 | −4.205 | −9.245 | 9.682 | 1.00 | 0.00 |
| ATOM | 762 | QG | GLU− | 46 | −4.205 | −9.245 | 9.682 | 1.00 | 0.00 |
| ATOM | 763 | CD | GLU− | 46 | −4.250 | −9.514 | 11.822 | 1.00 | 0.00 |
| ATOM | 764 | OE1 | GLU− | 46 | −3.153 | −10.109 | 11.742 | 1.00 | 0.00 |
| ATOM | 765 | OE2 | GLU− | 46 | −4.920 | −9.344 | 12.864 | 1.00 | 0.00 |
| ATOM | 766 | C | GLU− | 46 | −4.225 | −6.879 | 8.217 | 1.00 | 0.00 |
| ATOM | 767 | O | GLU− | 46 | −4.044 | −7.925 | 7.594 | 1.00 | 0.00 |
| ATOM | 768 | N | GLY | 47 | −4.752 | −5.779 | 7.698 | 1.00 | 0.00 |
| ATOM | 769 | H | GLY | 47 | −4.896 | −4.933 | 8.211 | 1.00 | 0.00 |
| ATOM | 770 | CA | GLY | 47 | −5.168 | −5.732 | 6.307 | 1.00 | 0.00 |
| ATOM | 771 | 1HA | GLY | 47 | −5.875 | −6.538 | 6.108 | 1.00 | 0.00 |
| ATOM | 772 | 2HA | GLY | 47 | −5.690 | −4.795 | 6.111 | 1.00 | 0.00 |
| ATOM | 773 | QA | GLY | 47 | −5.782 | −5.666 | 6.110 | 1.00 | 0.00 |
| ATOM | 774 | C | GLY | 47 | −3.965 | −5.857 | 5.370 | 1.00 | 0.00 |
| ATOM | 775 | O | GLY | 47 | −4.030 | −6.556 | 4.360 | 1.00 | 0.00 |
| ATOM | 776 | N | LEU | 48 | −2.894 | −5.169 | 5.740 | 1.00 | 0.00 |
| ATOM | 777 | H | LEU | 48 | −2.850 | −4.602 | 6.562 | 1.00 | 0.00 |
| ATOM | 778 | CA | LEU | 48 | −1.678 | −5.194 | 4.945 | 1.00 | 0.00 |
| ATOM | 779 | HA | LEU | 48 | −1.973 | −5.150 | 3.895 | 1.00 | 0.00 |
| ATOM | 780 | CB | LEU | 48 | −0.828 | −3.954 | 5.227 | 1.00 | 0.00 |
| ATOM | 781 | 2HB | LEU | 48 | −1.468 | −3.193 | 5.673 | 1.00 | 0.00 |
| ATOM | 782 | QB | LEU | 48 | −1.468 | −3.193 | 5.673 | 1.00 | 0.00 |
| ATOM | 783 | CG | LEU | 48 | 0.380 | −4.163 | 6.142 | 1.00 | 0.00 |

TABLE 4-continued

Mistic-L Atomic Structure Coordinates

| ATOM | 784 | HG | LEU | 48 | 0.049 | −4.709 | 7.026 | 1.00 | 0.00 |
|---|---|---|---|---|---|---|---|---|---|
| ATOM | 785 | QD1 | LEU | 48 | 1.699 | −5.223 | 5.292 | 1.00 | 0.00 |
| ATOM | 786 | QD2 | LEU | 48 | 1.077 | −2.506 | 6.737 | 1.00 | 0.00 |
| ATOM | 787 | CD1 | LEU | 48 | 1.446 | −5.019 | 5.455 | 1.00 | 0.00 |
| ATOM | 788 | 1HD1 | LEU | 48 | 1.050 | −5.409 | 4.517 | 1.00 | 0.00 |
| ATOM | 789 | 2HD1 | LEU | 48 | 2.327 | −4.410 | 5.253 | 1.00 | 0.00 |
| ATOM | 790 | 3HD1 | LEU | 48 | 1.721 | −5.850 | 6.106 | 1.00 | 0.00 |
| ATOM | 791 | CD2 | LEU | 48 | 0.943 | −2.824 | 6.622 | 1.00 | 0.00 |
| ATOM | 792 | 1HD2 | LEU | 48 | 1.262 | −2.916 | 7.661 | 1.00 | 0.00 |
| ATOM | 793 | 2HD2 | LEU | 48 | 1.796 | −2.546 | 6.004 | 1.00 | 0.00 |
| ATOM | 794 | 3HD2 | LEU | 48 | 0.172 | −2.058 | 6.545 | 1.00 | 0.00 |
| ATOM | 795 | QQD | LEU | 48 | 1.388 | −3.865 | 6.014 | 1.00 | 0.00 |
| ATOM | 796 | C | LEU | 48 | −0.942 | −6.513 | 5.188 | 1.00 | 0.00 |
| ATOM | 797 | O | LEU | 48 | −0.572 | −7.205 | 4.241 | 1.00 | 0.00 |
| ATOM | 798 | N | ASP− | 49 | −0.753 | −6.821 | 6.463 | 1.00 | 0.00 |
| ATOM | 799 | H | ASP− | 49 | −1.057 | −6.252 | 7.227 | 1.00 | 0.00 |
| ATOM | 800 | CA | ASP− | 49 | −0.068 | −8.045 | 6.843 | 1.00 | 0.00 |
| ATOM | 801 | HA | ASP− | 49 | 0.940 | −7.946 | 6.440 | 1.00 | 0.00 |
| ATOM | 802 | CB | ASP− | 49 | −0.031 | −8.206 | 8.364 | 1.00 | 0.00 |
| ATOM | 803 | 2HB | ASP− | 49 | −0.820 | −8.898 | 8.660 | 1.00 | 0.00 |
| ATOM | 804 | QB | ASP− | 49 | −0.820 | −8.898 | 8.660 | 1.00 | 0.00 |
| ATOM | 805 | CG | ASP− | 49 | 1.300 | −8.709 | 8.928 | 1.00 | 0.00 |
| ATOM | 806 | OD1 | ASP− | 49 | 2.214 | −8.937 | 8.108 | 1.00 | 0.00 |
| ATOM | 807 | OD2 | ASP− | 49 | 1.371 | −8.853 | 10.168 | 1.00 | 0.00 |
| ATOM | 808 | C | ASP− | 49 | −0.816 | −9.246 | 6.258 | 1.00 | 0.00 |
| ATOM | 809 | O | ASP− | 49 | −0.200 | −10.246 | 5.891 | 1.00 | 0.00 |
| ATOM | 810 | N | ALA | 50 | −2.131 | −9.106 | 6.189 | 1.00 | 0.00 |
| ATOM | 811 | H | ALA | 50 | −2.623 | −8.290 | 6.489 | 1.00 | 0.00 |
| ATOM | 812 | CA | ALA | 50 | −2.969 | −10.166 | 5.655 | 1.00 | 0.00 |
| ATOM | 813 | HA | ALA | 50 | −2.554 | −11.118 | 5.990 | 1.00 | 0.00 |
| ATOM | 814 | QB | ALA | 50 | −4.724 | −9.991 | 6.343 | 1.00 | 0.00 |
| ATOM | 815 | CB | ALA | 50 | −4.388 | −10.025 | 6.211 | 1.00 | 0.00 |
| ATOM | 816 | 1HB | ALA | 50 | −5.008 | −10.838 | 5.835 | 1.00 | 0.00 |
| ATOM | 817 | 2HB | ALA | 50 | −4.357 | −10.065 | 7.300 | 1.00 | 0.00 |
| ATOM | 818 | 3HB | ALA | 50 | −4.808 | −9.071 | 5.895 | 1.00 | 0.00 |
| ATOM | 819 | C | ALA | 50 | −2.934 | −10.118 | 4.127 | 1.00 | 0.00 |
| ATOM | 820 | O | ALA | 50 | −2.354 | −10.994 | 3.487 | 1.00 | 0.00 |
| ATOM | 821 | N | PHE | 51 | −3.561 | −9.084 | 3.585 | 1.00 | 0.00 |
| ATOM | 822 | H | PHE | 51 | −4.030 | −8.376 | 4.112 | 1.00 | 0.00 |
| ATOM | 823 | CA | PHE | 51 | −3.609 | −8.910 | 2.143 | 1.00 | 0.00 |
| ATOM | 824 | HA | PHE | 51 | −4.331 | −9.628 | 1.754 | 1.00 | 0.00 |
| ATOM | 825 | CB | PHE | 51 | −4.005 | −7.455 | 1.881 | 1.00 | 0.00 |
| ATOM | 826 | 2HB | PHE | 51 | −3.174 | −6.807 | 2.160 | 1.00 | 0.00 |
| ATOM | 827 | QB | PHE | 51 | −3.174 | −6.807 | 2.160 | 1.00 | 0.00 |
| ATOM | 828 | QD | PHE | 51 | −4.428 | −7.142 | 0.302 | 1.00 | 0.00 |
| ATOM | 829 | QE | PHE | 51 | −5.065 | −6.670 | −2.080 | 1.00 | 0.00 |
| ATOM | 830 | QR | PHE | 51 | −4.873 | −6.812 | −1.360 | 1.00 | 0.00 |
| ATOM | 831 | CG | PHE | 51 | −4.394 | −7.167 | 0.430 | 1.00 | 0.00 |
| ATOM | 832 | CD1 | PHE | 51 | −3.493 | −7.372 | −0.568 | 1.00 | 0.00 |
| ATOM | 833 | 1HD | PHE | 51 | −2.495 | −7.741 | −0.334 | 1.00 | 0.00 |
| ATOM | 834 | CE1 | PHE | 51 | −3.853 | −7.105 | −1.916 | 1.00 | 0.00 |
| ATOM | 835 | 1HE | PHE | 51 | −3.132 | −7.269 | −2.715 | 1.00 | 0.00 |
| ATOM | 836 | CZ | PHE | 51 | −5.099 | −6.644 | −2.208 | 1.00 | 0.00 |
| ATOM | 837 | HZ | PHE | 51 | −5.376 | −6.439 | −3.242 | 1.00 | 0.00 |
| ATOM | 838 | CE2 | PHE | 51 | −6.000 | −6.439 | −1.209 | 1.00 | 0.00 |
| ATOM | 839 | 2HE | PHE | 51 | −6.999 | −6.070 | −1.444 | 1.00 | 0.00 |
| ATOM | 840 | CD2 | PHE | 51 | −5.640 | −6.707 | 0.138 | 1.00 | 0.00 |
| ATOM | 841 | 2HD | PHE | 51 | −6.362 | −6.543 | 0.937 | 1.00 | 0.00 |
| ATOM | 842 | C | PHE | 51 | −2.241 | −9.174 | 1.513 | 1.00 | 0.00 |
| ATOM | 843 | O | PHE | 51 | −2.152 | −9.775 | 0.443 | 1.00 | 0.00 |
| ATOM | 844 | N | ILE | 52 | −1.208 | −8.713 | 2.203 | 1.00 | 0.00 |
| ATOM | 845 | H | ILE | 52 | −1.289 | −8.226 | 3.072 | 1.00 | 0.00 |
| ATOM | 846 | CA | ILE | 52 | 0.152 | −8.892 | 1.725 | 1.00 | 0.00 |
| ATOM | 847 | HA | ILE | 52 | 0.190 | −8.518 | 0.702 | 1.00 | 0.00 |
| ATOM | 848 | CB | ILE | 52 | 1.126 | −8.050 | 2.551 | 1.00 | 0.00 |
| ATOM | 849 | HB | ILE | 52 | 0.658 | −7.089 | 2.756 | 1.00 | 0.00 |
| ATOM | 850 | QG2 | ILE | 52 | 1.480 | −8.868 | 4.222 | 1.00 | 0.00 |
| ATOM | 851 | CG2 | ILE | 52 | 1.412 | −8.711 | 3.902 | 1.00 | 0.00 |
| ATOM | 852 | 1HG2 | ILE | 52 | 0.487 | −9.118 | 4.310 | 1.00 | 0.00 |
| ATOM | 853 | 2HG2 | ILE | 52 | 2.134 | −9.516 | 3.767 | 1.00 | 0.00 |
| ATOM | 854 | 3HG2 | ILE | 52 | 1.818 | −7.970 | 4.590 | 1.00 | 0.00 |
| ATOM | 855 | CG1 | ILE | 52 | 2.410 | −7.770 | 1.768 | 1.00 | 0.00 |
| ATOM | 856 | 2HG1 | ILE | 52 | 2.926 | −6.914 | 2.202 | 1.00 | 0.00 |
| ATOM | 857 | QG1 | ILE | 52 | 2.926 | −6.914 | 2.202 | 1.00 | 0.00 |
| ATOM | 858 | QD1 | ILE | 52 | 3.555 | −9.278 | 1.779 | 1.00 | 0.00 |
| ATOM | 859 | CD1 | ILE | 52 | 3.336 | −8.989 | 1.776 | 1.00 | 0.00 |
| ATOM | 860 | 1HD1 | ILE | 52 | 3.981 | −8.961 | 0.899 | 1.00 | 0.00 |
| ATOM | 861 | 2HD1 | ILE | 52 | 3.947 | −8.974 | 2.679 | 1.00 | 0.00 |

TABLE 4-continued

Mistic-L Atomic Structure Coordinates

| ATOM | 862 | 3HD1 | ILE | 52 | 2.737 | −9.900 | 1.759 | 1.00 | 0.00 |
|---|---|---|---|---|---|---|---|---|---|
| ATOM | 863 | C | ILE | 52 | 0.489 | −10.384 | 1.707 | 1.00 | 0.00 |
| ATOM | 864 | O | ILE | 52 | 1.066 | −10.883 | 0.742 | 1.00 | 0.00 |
| ATOM | 865 | N | GLN | 53 | 0.116 | −11.055 | 2.787 | 1.00 | 0.00 |
| ATOM | 866 | H | GLN | 53 | −0.353 | −10.642 | 3.568 | 1.00 | 0.00 |
| ATOM | 867 | CA | GLN | 53 | 0.371 | −12.481 | 2.908 | 1.00 | 0.00 |
| ATOM | 868 | HA | GLN | 53 | 1.421 | −12.610 | 2.644 | 1.00 | 0.00 |
| ATOM | 869 | CB | GLN | 53 | 0.154 | −12.957 | 4.346 | 1.00 | 0.00 |
| ATOM | 870 | 2HB | GLN | 53 | 0.308 | −12.126 | 5.035 | 1.00 | 0.00 |
| ATOM | 871 | QB | GLN | 53 | 0.308 | −12.126 | 5.035 | 1.00 | 0.00 |
| ATOM | 872 | CG | GLN | 53 | −1.255 | −13.524 | 4.529 | 1.00 | 0.00 |
| ATOM | 873 | 2HG | GLN | 53 | −1.928 | −13.077 | 3.796 | 1.00 | 0.00 |
| ATOM | 874 | QG | GLN | 53 | −1.928 | −13.077 | 3.796 | 1.00 | 0.00 |
| ATOM | 875 | CD | GLN | 53 | −1.258 | −15.046 | 4.372 | 1.00 | 0.00 |
| ATOM | 876 | OE1 | GLN | 53 | −0.234 | −15.676 | 4.163 | 1.00 | 0.00 |
| ATOM | 877 | NE2 | GLN | 53 | −2.463 | −15.598 | 4.483 | 1.00 | 0.00 |
| ATOM | 878 | 1HE2 | GLN | 53 | −3.263 | −15.024 | 4.654 | 1.00 | 0.00 |
| ATOM | 879 | 2HE2 | GLN | 53 | −2.568 | −16.589 | 4.395 | 1.00 | 0.00 |
| ATOM | 880 | QE2 | GLN | 53 | −2.915 | −15.806 | 4.525 | 1.00 | 0.00 |
| ATOM | 881 | C | GLN | 53 | −0.510 | −13.263 | 1.932 | 1.00 | 0.00 |
| ATOM | 882 | O | GLN | 53 | −0.330 | −14.467 | 1.756 | 1.00 | 0.00 |
| ATOM | 883 | N | LEU | 54 | −1.445 | −12.547 | 1.324 | 1.00 | 0.00 |
| ATOM | 884 | H | LEU | 54 | −1.584 | −11.569 | 1.473 | 1.00 | 0.00 |
| ATOM | 885 | CA | LEU | 54 | −2.354 | −13.159 | 0.371 | 1.00 | 0.00 |
| ATOM | 886 | HA | LEU | 54 | −2.228 | −14.239 | 0.446 | 1.00 | 0.00 |
| ATOM | 887 | CB | LEU | 54 | −3.806 | −12.848 | 0.741 | 1.00 | 0.00 |
| ATOM | 888 | 2HB | LEU | 54 | −4.367 | −12.685 | −0.180 | 1.00 | 0.00 |
| ATOM | 889 | QB | LEU | 54 | −4.367 | −12.685 | −0.180 | 1.00 | 0.00 |
| ATOM | 890 | CG | LEU | 54 | −4.532 | −13.913 | 1.565 | 1.00 | 0.00 |
| ATOM | 891 | HG | LEU | 54 | −3.796 | −14.644 | 1.902 | 1.00 | 0.00 |
| ATOM | 892 | QD1 | LEU | 54 | −5.316 | −13.155 | 3.112 | 1.00 | 0.00 |
| ATOM | 893 | QD2 | LEU | 54 | −5.799 | −14.842 | 0.509 | 1.00 | 0.00 |
| ATOM | 894 | CD1 | LEU | 54 | −5.166 | −13.301 | 2.816 | 1.00 | 0.00 |
| ATOM | 895 | 1HD1 | LEU | 54 | −5.284 | −14.071 | 3.577 | 1.00 | 0.00 |
| ATOM | 896 | 2HD1 | LEU | 54 | −4.523 | −12.508 | 3.198 | 1.00 | 0.00 |
| ATOM | 897 | 3HD1 | LEU | 54 | −6.141 | −12.887 | 2.563 | 1.00 | 0.00 |
| ATOM | 898 | CD2 | LEU | 54 | −5.556 | −14.664 | 0.712 | 1.00 | 0.00 |
| ATOM | 899 | 1HD2 | LEU | 54 | −5.088 | −15.547 | 0.277 | 1.00 | 0.00 |
| ATOM | 900 | 2HD2 | LEU | 54 | −6.396 | −14.968 | 1.337 | 1.00 | 0.00 |
| ATOM | 901 | 3HD2 | LEU | 54 | −5.912 | −14.011 | −0.085 | 1.00 | 0.00 |
| ATOM | 902 | QQD | LEU | 54 | −5.558 | −13.999 | 1.811 | 1.00 | 0.00 |
| ATOM | 903 | C | LEU | 54 | −1.973 | −12.722 | −1.045 | 1.00 | 0.00 |
| ATOM | 904 | O | LEU | 54 | −2.229 | −13.441 | −2.010 | 1.00 | 0.00 |
| ATOM | 905 | N | TYR | 55 | −1.367 | −11.547 | −1.124 | 1.00 | 0.00 |
| ATOM | 906 | H | TYR | 55 | −1.163 | −10.969 | −0.334 | 1.00 | 0.00 |
| ATOM | 907 | CA | TYR | 55 | −0.948 | −11.005 | −2.405 | 1.00 | 0.00 |
| ATOM | 908 | HA | TYR | 55 | −1.201 | −11.732 | −3.177 | 1.00 | 0.00 |
| ATOM | 909 | CB | TYR | 55 | −1.674 | −9.668 | −2.557 | 1.00 | 0.00 |
| ATOM | 910 | 2HB | TYR | 55 | −1.096 | −9.024 | −3.219 | 1.00 | 0.00 |
| ATOM | 911 | QB | TYR | 55 | −1.096 | −9.024 | −3.219 | 1.00 | 0.00 |
| ATOM | 912 | QD | TYR | 55 | −3.233 | −9.802 | −3.155 | 1.00 | 0.00 |
| ATOM | 913 | QE | TYR | 55 | −5.598 | −10.007 | −4.065 | 1.00 | 0.00 |
| ATOM | 914 | QR | TYR | 55 | −4.415 | −9.904 | −3.610 | 1.00 | 0.00 |
| ATOM | 915 | CG | TYR | 55 | −3.097 | −9.790 | −3.104 | 1.00 | 0.00 |
| ATOM | 916 | CD1 | TYR | 55 | −4.001 | −10.635 | −2.492 | 1.00 | 0.00 |
| ATOM | 917 | 1HD | TYR | 55 | −3.701 | −11.216 | −1.619 | 1.00 | 0.00 |
| ATOM | 918 | CE1 | TYR | 55 | −5.341 | −10.751 | −3.007 | 1.00 | 0.00 |
| ATOM | 919 | 1HE | TYR | 55 | −6.065 | −11.415 | −2.534 | 1.00 | 0.00 |
| ATOM | 920 | CZ | TYR | 55 | −5.683 | −10.014 | −4.098 | 1.00 | 0.00 |
| ATOM | 921 | CE2 | TYR | 55 | −4.818 | −9.173 | −4.723 | 1.00 | 0.00 |
| ATOM | 922 | 2HE | TYR | 55 | −5.131 | −8.598 | −5.596 | 1.00 | 0.00 |
| ATOM | 923 | CD2 | TYR | 55 | −3.478 | −9.057 | −4.209 | 1.00 | 0.00 |
| ATOM | 924 | 2HD | TYR | 55 | −2.764 | −8.389 | −4.691 | 1.00 | 0.00 |
| ATOM | 925 | OH | TYR | 55 | −6.949 | −10.124 | −4.583 | 1.00 | 0.00 |
| ATOM | 926 | HH | TYR | 55 | −7.357 | −10.984 | −4.282 | 1.00 | 0.00 |
| ATOM | 927 | C | TYR | 55 | 0.562 | −10.757 | −2.429 | 1.00 | 0.00 |
| ATOM | 928 | O | TYR | 55 | 1.287 | −11.395 | −3.191 | 1.00 | 0.00 |
| ATOM | 929 | N | ASN | 56 | 0.991 | −9.831 | −1.584 | 1.00 | 0.00 |
| ATOM | 930 | H | ASN | 56 | 0.394 | −9.317 | −0.967 | 1.00 | 0.00 |
| ATOM | 931 | CA | ASN | 56 | 2.401 | −9.491 | −1.498 | 1.00 | 0.00 |
| ATOM | 932 | HA | ASN | 56 | 2.472 | −8.770 | −0.685 | 1.00 | 0.00 |
| ATOM | 933 | CB | ASN | 56 | 3.248 | −10.730 | −1.199 | 1.00 | 0.00 |
| ATOM | 934 | 2HB | ASN | 56 | 3.119 | −11.464 | −1.994 | 1.00 | 0.00 |
| ATOM | 935 | QB | ASN | 56 | 3.119 | −11.464 | −1.994 | 1.00 | 0.00 |
| ATOM | 936 | CG | ASN | 56 | 4.728 | −10.364 | −1.072 | 1.00 | 0.00 |
| ATOM | 937 | OD1 | ASN | 56 | 5.108 | −9.204 | −1.059 | 1.00 | 0.00 |
| ATOM | 938 | ND2 | ASN | 56 | 5.539 | −11.413 | −0.979 | 1.00 | 0.00 |
| ATOM | 939 | 1HD2 | ASN | 56 | 5.162 | −12.339 | −0.995 | 1.00 | 0.00 |

TABLE 4-continued

Mistic-L Atomic Structure Coordinates

| ATOM | 940 | 2HD2 | ASN | 56 | 6.526 | −11.277 | −0.892 | 1.00 | 0.00 |
|------|-----|------|-----|----|-------|---------|--------|------|------|
| ATOM | 941 | QD2 | ASN | 56 | 5.844 | −11.808 | −0.943 | 1.00 | 0.00 |
| ATOM | 942 | C | ASN | 56 | 2.864 | −8.913 | −2.837 | 1.00 | 0.00 |
| ATOM | 943 | O | ASN | 56 | 4.026 | −9.064 | −3.213 | 1.00 | 0.00 |
| ATOM | 944 | N | GLU− | 57 | 1.932 | −8.264 | −3.519 | 1.00 | 0.00 |
| ATOM | 945 | H | GLU− | 57 | 0.990 | −8.146 | −3.206 | 1.00 | 0.00 |
| ATOM | 946 | CA | GLU− | 57 | 2.231 | −7.662 | −4.807 | 1.00 | 0.00 |
| ATOM | 947 | HA | GLU− | 57 | 3.316 | −7.703 | −4.902 | 1.00 | 0.00 |
| ATOM | 948 | CB | GLU− | 57 | 1.598 | −8.464 | −5.946 | 1.00 | 0.00 |
| ATOM | 949 | 2HB | GLU− | 57 | 0.565 | −8.148 | −6.089 | 1.00 | 0.00 |
| ATOM | 950 | QB | GLU− | 57 | 0.565 | −8.148 | −6.089 | 1.00 | 0.00 |
| ATOM | 951 | CG | GLU− | 57 | 2.378 | −8.276 | −7.249 | 1.00 | 0.00 |
| ATOM | 952 | 2HG | GLU− | 57 | 2.419 | −7.217 | −7.503 | 1.00 | 0.00 |
| ATOM | 953 | QG | GLU− | 57 | 2.419 | −7.217 | −7.503 | 1.00 | 0.00 |
| ATOM | 954 | CD | GLU− | 57 | 3.798 | −8.832 | −7.123 | 1.00 | 0.00 |
| ATOM | 955 | OE1 | GLU− | 57 | 3.981 | −9.734 | −6.277 | 1.00 | 0.00 |
| ATOM | 956 | OE2 | GLU− | 57 | 4.668 | −8.341 | −7.875 | 1.00 | 0.00 |
| ATOM | 957 | C | GLU− | 57 | 1.761 | −6.207 | −4.835 | 1.00 | 0.00 |
| ATOM | 958 | O | GLU− | 57 | 2.076 | −5.467 | −5.766 | 1.00 | 0.00 |
| ATOM | 959 | N | SER | 58 | 1.015 | −5.839 | −3.804 | 1.00 | 0.00 |
| ATOM | 960 | H | SER | 58 | 0.763 | −6.447 | −3.051 | 1.00 | 0.00 |
| ATOM | 961 | CA | SER | 58 | 0.499 | −4.485 | −3.698 | 1.00 | 0.00 |
| ATOM | 962 | HA | SER | 58 | 0.451 | −4.277 | −2.629 | 1.00 | 0.00 |
| ATOM | 963 | CB | SER | 58 | 1.440 | −3.483 | −4.370 | 1.00 | 0.00 |
| ATOM | 964 | 2HB | SER | 58 | 1.217 | −3.434 | −5.436 | 1.00 | 0.00 |
| ATOM | 965 | QB | SER | 58 | 1.217 | −3.434 | −5.436 | 1.00 | 0.00 |
| ATOM | 966 | OG | SER | 58 | 1.327 | −2.181 | −3.802 | 1.00 | 0.00 |
| ATOM | 967 | HG | SER | 58 | 1.698 | −2.179 | −2.874 | 1.00 | 0.00 |
| ATOM | 968 | C | SER | 58 | −0.895 | −4.406 | −4.324 | 1.00 | 0.00 |
| ATOM | 969 | O | SER | 58 | −1.372 | −3.320 | −4.652 | 1.00 | 0.00 |
| ATOM | 970 | N | GLU− | 59 | −1.509 | −5.570 | −4.472 | 1.00 | 0.00 |
| ATOM | 971 | H | GLU− | 59 | −1.115 | −6.449 | −4.203 | 1.00 | 0.00 |
| ATOM | 972 | CA | GLU− | 59 | −2.839 | −5.647 | −5.054 | 1.00 | 0.00 |
| ATOM | 973 | HA | GLU− | 59 | −3.335 | −6.467 | −4.535 | 1.00 | 0.00 |
| ATOM | 974 | CB | GLU− | 59 | −3.620 | −4.354 | −4.807 | 1.00 | 0.00 |
| ATOM | 975 | 2HB | GLU− | 59 | −3.349 | −3.612 | −5.558 | 1.00 | 0.00 |
| ATOM | 976 | QB | GLU− | 59 | −3.349 | −3.612 | −5.558 | 1.00 | 0.00 |
| ATOM | 977 | CG | GLU− | 59 | −5.128 | −4.607 | −4.854 | 1.00 | 0.00 |
| ATOM | 978 | 2HG | GLU− | 59 | −5.563 | −4.416 | −3.873 | 1.00 | 0.00 |
| ATOM | 979 | QG | GLU− | 59 | −5.563 | −4.416 | −3.873 | 1.00 | 0.00 |
| ATOM | 980 | CD | GLU− | 59 | −5.802 | −3.716 | −5.899 | 1.00 | 0.00 |
| ATOM | 981 | OE1 | GLU− | 59 | −5.128 | −3.417 | −6.908 | 1.00 | 0.00 |
| ATOM | 982 | OE2 | GLU− | 59 | −6.975 | −3.354 | −5.665 | 1.00 | 0.00 |
| ATOM | 983 | C | GLU− | 59 | −2.747 | −5.956 | −6.549 | 1.00 | 0.00 |
| ATOM | 984 | O | GLU− | 59 | −3.276 | −5.211 | −7.373 | 1.00 | 0.00 |
| ATOM | 985 | N | ILE | 60 | −2.075 | −7.056 | −6.853 | 1.00 | 0.00 |
| ATOM | 986 | H | ILE | 60 | −1.648 | −7.656 | −6.177 | 1.00 | 0.00 |
| ATOM | 987 | CA | ILE | 60 | −1.907 | −7.472 | −8.235 | 1.00 | 0.00 |
| ATOM | 988 | HA | ILE | 60 | −1.858 | −6.570 | −8.845 | 1.00 | 0.00 |
| ATOM | 989 | CB | ILE | 60 | −0.580 | −8.213 | −8.414 | 1.00 | 0.00 |
| ATOM | 990 | HB | ILE | 60 | 0.198 | −7.650 | −7.900 | 1.00 | 0.00 |
| ATOM | 991 | QG2 | ILE | 60 | −0.649 | −9.929 | −7.617 | 1.00 | 0.00 |
| ATOM | 992 | CG2 | ILE | 60 | −0.636 | −9.600 | −7.770 | 1.00 | 0.00 |
| ATOM | 993 | 1HG2 | ILE | 60 | −0.999 | −9.511 | −6.746 | 1.00 | 0.00 |
| ATOM | 994 | 2HG2 | ILE | 60 | −1.310 | −10.239 | −8.341 | 1.00 | 0.00 |
| ATOM | 995 | 3HG2 | ILE | 60 | 0.362 | −10.038 | −7.766 | 1.00 | 0.00 |
| ATOM | 996 | CG1 | ILE | 60 | −0.186 | −8.283 | −9.891 | 1.00 | 0.00 |
| ATOM | 997 | 2HG1 | ILE | 60 | 0.430 | −9.164 | −10.066 | 1.00 | 0.00 |
| ATOM | 998 | QG1 | ILE | 60 | 0.430 | −9.164 | −10.066 | 1.00 | 0.00 |
| ATOM | 999 | QD1 | ILE | 60 | −1.720 | −8.346 | −11.000 | 1.00 | 0.00 |
| ATOM | 1000 | CD1 | ILE | 60 | −1.425 | −8.334 | −10.787 | 1.00 | 0.00 |
| ATOM | 1001 | 1HD1 | ILE | 60 | −2.019 | −7.431 | −10.639 | 1.00 | 0.00 |
| ATOM | 1002 | 2HD1 | ILE | 60 | −1.117 | −8.398 | −11.831 | 1.00 | 0.00 |
| ATOM | 1003 | 3HD1 | ILE | 60 | −2.024 | −9.208 | −10.531 | 1.00 | 0.00 |
| ATOM | 1004 | C | ILE | 60 | −3.129 | −8.284 | −8.670 | 1.00 | 0.00 |
| ATOM | 1005 | O | ILE | 60 | −3.765 | −7.966 | −9.673 | 1.00 | 0.00 |
| ATOM | 1006 | N | ASP− | 61 | −3.420 | −9.318 | −7.892 | 1.00 | 0.00 |
| ATOM | 1007 | H | ASP− | 61 | −2.897 | −9.569 | −7.078 | 1.00 | 0.00 |
| ATOM | 1008 | CA | ASP− | 61 | −4.554 | −10.177 | −8.184 | 1.00 | 0.00 |
| ATOM | 1009 | HA | ASP− | 61 | −4.181 | −10.912 | −8.899 | 1.00 | 0.00 |
| ATOM | 1010 | CB | ASP− | 61 | −5.064 | −10.866 | −6.917 | 1.00 | 0.00 |
| ATOM | 1011 | 2HB | ASP− | 61 | −5.875 | −10.270 | −6.499 | 1.00 | 0.00 |
| ATOM | 1012 | QB | ASP− | 61 | −5.875 | −10.270 | −6.499 | 1.00 | 0.00 |
| ATOM | 1013 | CG | ASP− | 61 | −5.562 | −12.299 | −7.116 | 1.00 | 0.00 |
| ATOM | 1014 | OD1 | ASP− | 61 | −6.652 | −12.444 | −7.710 | 1.00 | 0.00 |
| ATOM | 1015 | OD2 | ASP− | 61 | −4.842 | −13.218 | −6.667 | 1.00 | 0.00 |
| ATOM | 1016 | C | ASP− | 61 | −5.695 | −9.333 | −8.756 | 1.00 | 0.00 |
| ATOM | 1017 | O | ASP− | 61 | −6.346 | −9.734 | −9.720 | 1.00 | 0.00 |

TABLE 4-continued

Mistic-L Atomic Structure Coordinates

| ATOM | 1018 | N | GLU- | 62 | -5.903 | -8.181 | -8.136 | 1.00 | 0.00 |
|---|---|---|---|---|---|---|---|---|---|
| ATOM | 1019 | H | GLU- | 62 | -5.369 | -7.863 | -7.353 | 1.00 | 0.00 |
| ATOM | 1020 | CA | GLU- | 62 | -6.954 | -7.277 | -8.571 | 1.00 | 0.00 |
| ATOM | 1021 | HA | GLU- | 62 | -7.863 | -7.878 | -8.594 | 1.00 | 0.00 |
| ATOM | 1022 | CB | GLU- | 62 | -7.138 | -6.129 | -7.575 | 1.00 | 0.00 |
| ATOM | 1023 | 2HB | GLU- | 62 | -6.867 | -5.186 | -8.048 | 1.00 | 0.00 |
| ATOM | 1024 | QB | GLU- | 62 | -6.867 | -5.186 | -8.048 | 1.00 | 0.00 |
| ATOM | 1025 | CG | GLU- | 62 | -8.583 | -6.061 | -7.076 | 1.00 | 0.00 |
| ATOM | 1026 | 2HG | GLU- | 62 | -8.601 | -5.680 | -6.056 | 1.00 | 0.00 |
| ATOM | 1027 | QG | GLU- | 62 | -8.601 | -5.680 | -6.056 | 1.00 | 0.00 |
| ATOM | 1028 | CD | GLU- | 62 | -9.431 | -5.163 | -7.979 | 1.00 | 0.00 |
| ATOM | 1029 | OE1 | GLU- | 62 | -9.130 | -3.951 | -8.017 | 1.00 | 0.00 |
| ATOM | 1030 | OE2 | GLU- | 62 | -10.362 | -5.709 | -8.610 | 1.00 | 0.00 |
| ATOM | 1031 | C | GLU- | 62 | -6.650 | -6.742 | -9.971 | 1.00 | 0.00 |
| ATOM | 1032 | O | GLU- | 62 | -5.638 | -6.075 | -10.179 | 1.00 | 0.00 |
| ATOM | 1033 | N | PRO | 63 | -7.568 | -7.065 | -10.922 | 1.00 | 0.00 |
| ATOM | 1034 | CD | PRO | 63 | -8.779 | -7.853 | -10.713 | 1.00 | 0.00 |
| ATOM | 1035 | CA | PRO | 63 | -7.407 | -6.625 | -12.297 | 1.00 | 0.00 |
| ATOM | 1036 | HA | PRO | 63 | -6.454 | -6.725 | -12.585 | 1.00 | 0.00 |
| ATOM | 1037 | CB | PRO | 63 | -8.336 | -7.515 | -13.106 | 1.00 | 0.00 |
| ATOM | 1038 | 2HB | PRO | 63 | -7.779 | -8.303 | -13.613 | 1.00 | 0.00 |
| ATOM | 1039 | QB | PRO | 63 | -7.779 | -8.303 | -13.613 | 1.00 | 0.00 |
| ATOM | 1040 | CG | PRO | 63 | -9.323 | -8.102 | -12.110 | 1.00 | 0.00 |
| ATOM | 1041 | 2HG | PRO | 63 | -9.453 | -9.170 | -12.285 | 1.00 | 0.00 |
| ATOM | 1042 | QG | PRO | 63 | -9.453 | -9.170 | -12.285 | 1.00 | 0.00 |
| ATOM | 1043 | 2HD | PRO | 63 | -8.557 | -8.790 | -10.202 | 1.00 | 0.00 |
| ATOM | 1044 | QD | PRO | 63 | -8.557 | -8.790 | -10.202 | 1.00 | 0.00 |
| ATOM | 1045 | C | PRO | 63 | -7.732 | -5.137 | -12.439 | 1.00 | 0.00 |
| ATOM | 1046 | O | PRO | 63 | -8.894 | -4.764 | -12.599 | 1.00 | 0.00 |
| ATOM | 1047 | N | LEU | 64 | -6.686 | -4.327 | -12.375 | 1.00 | 0.00 |
| ATOM | 1048 | H | LEU | 64 | -5.745 | -4.638 | -12.244 | 1.00 | 0.00 |
| ATOM | 1049 | CA | LEU | 64 | -6.846 | -2.887 | -12.493 | 1.00 | 0.00 |
| ATOM | 1050 | HA | LEU | 64 | -7.882 | -2.695 | -12.772 | 1.00 | 0.00 |
| ATOM | 1051 | CB | LEU | 64 | -6.607 | -2.208 | -11.143 | 1.00 | 0.00 |
| ATOM | 1052 | 2HB | LEU | 64 | -5.913 | -1.381 | -11.292 | 1.00 | 0.00 |
| ATOM | 1053 | QB | LEU | 64 | -5.913 | -1.381 | -11.292 | 1.00 | 0.00 |
| ATOM | 1054 | CG | LEU | 64 | -7.852 | -1.671 | -10.434 | 1.00 | 0.00 |
| ATOM | 1055 | HG | LEU | 64 | -7.652 | -1.652 | -9.362 | 1.00 | 0.00 |
| ATOM | 1056 | QD1 | LEU | 64 | -8.221 | 0.108 | -10.965 | 1.00 | 0.00 |
| ATOM | 1057 | QD2 | LEU | 64 | -9.335 | -2.815 | -10.706 | 1.00 | 0.00 |
| ATOM | 1058 | CD1 | LEU | 64 | -8.150 | -0.233 | -10.863 | 1.00 | 0.00 |
| ATOM | 1059 | 1HD1 | LEU | 64 | -9.219 | -0.124 | -11.049 | 1.00 | 0.00 |
| ATOM | 1060 | 2HD1 | LEU | 64 | -7.847 | 0.453 | -10.073 | 1.00 | 0.00 |
| ATOM | 1061 | 3HD1 | LEU | 64 | -7.598 | -0.004 | -11.774 | 1.00 | 0.00 |
| ATOM | 1062 | CD2 | LEU | 64 | -9.050 | -2.596 | -10.653 | 1.00 | 0.00 |
| ATOM | 1063 | 1HD2 | LEU | 64 | -9.552 | -2.325 | -11.582 | 1.00 | 0.00 |
| ATOM | 1064 | 2HD2 | LEU | 64 | -8.707 | -3.628 | -10.714 | 1.00 | 0.00 |
| ATOM | 1065 | 3HD2 | LEU | 64 | -9.747 | -2.493 | -9.821 | 1.00 | 0.00 |
| ATOM | 1066 | QQD | LEU | 64 | -8.778 | -1.354 | -10.835 | 1.00 | 0.00 |
| ATOM | 1067 | C | LEU | 64 | -5.939 | -2.368 | -13.611 | 1.00 | 0.00 |
| ATOM | 1068 | O | LEU | 64 | -6.422 | -1.955 | -14.665 | 1.00 | 0.00 |
| ATOM | 1069 | N | ILE | 65 | -4.643 | -2.406 | -13.344 | 1.00 | 0.00 |
| ATOM | 1070 | H | ILE | 65 | -4.258 | -2.742 | -12.484 | 1.00 | 0.00 |
| ATOM | 1071 | CA | ILE | 65 | -3.664 | -1.944 | -14.314 | 1.00 | 0.00 |
| ATOM | 1072 | HA | ILE | 65 | -4.130 | -1.996 | -15.297 | 1.00 | 0.00 |
| ATOM | 1073 | CB | ILE | 65 | -3.307 | -0.478 | -14.058 | 1.00 | 0.00 |
| ATOM | 1074 | HB | ILE | 65 | -4.148 | -0.005 | -13.551 | 1.00 | 0.00 |
| ATOM | 1075 | QG2 | ILE | 65 | -1.808 | -0.334 | -12.911 | 1.00 | 0.00 |
| ATOM | 1076 | CG2 | ILE | 65 | -2.096 | -0.361 | -13.132 | 1.00 | 0.00 |
| ATOM | 1077 | 1HG2 | ILE | 65 | -1.182 | -0.506 | -13.707 | 1.00 | 0.00 |
| ATOM | 1078 | 2HG2 | ILE | 65 | -2.083 | 0.626 | -12.671 | 1.00 | 0.00 |
| ATOM | 1079 | 3HG2 | ILE | 65 | -2.159 | -1.124 | -12.354 | 1.00 | 0.00 |
| ATOM | 1080 | CG1 | ILE | 65 | -3.095 | 0.272 | -15.376 | 1.00 | 0.00 |
| ATOM | 1081 | 2HG1 | ILE | 65 | -2.651 | 1.247 | -15.175 | 1.00 | 0.00 |
| ATOM | 1082 | QG1 | ILE | 65 | -2.651 | 1.247 | -15.175 | 1.00 | 0.00 |
| ATOM | 1083 | QD1 | ILE | 65 | -1.974 | -0.712 | -16.543 | 1.00 | 0.00 |
| ATOM | 1084 | CD1 | ILE | 65 | -2.189 | -0.523 | -16.319 | 1.00 | 0.00 |
| ATOM | 1085 | 1HD1 | ILE | 65 | -1.224 | -0.691 | -15.841 | 1.00 | 0.00 |
| ATOM | 1086 | 2HD1 | ILE | 65 | -2.653 | -1.483 | -16.545 | 1.00 | 0.00 |
| ATOM | 1087 | 3HD1 | ILE | 65 | -2.045 | 0.038 | -17.242 | 1.00 | 0.00 |
| ATOM | 1088 | C | ILE | 65 | -2.456 | -2.883 | -14.299 | 1.00 | 0.00 |
| ATOM | 1089 | O | ILE | 65 | -1.878 | -3.172 | -15.345 | 1.00 | 0.00 |
| ATOM | 1090 | N | GLN | 66 | -2.110 | -3.332 | -13.101 | 1.00 | 0.00 |
| ATOM | 1091 | H | GLN | 66 | -2.586 | -3.091 | -12.255 | 1.00 | 0.00 |
| ATOM | 1092 | CA | GLN | 66 | -0.981 | -4.232 | -12.937 | 1.00 | 0.00 |
| ATOM | 1093 | HA | GLN | 66 | -1.263 | -5.148 | -13.457 | 1.00 | 0.00 |
| ATOM | 1094 | CB | GLN | 66 | 0.279 | -3.655 | -13.584 | 1.00 | 0.00 |
| ATOM | 1095 | 2HB | GLN | 66 | 0.886 | -3.156 | -12.828 | 1.00 | 0.00 |

TABLE 4-continued

Mistic-L Atomic Structure Coordinates

| ATOM | 1096 | QB | GLN | 66 | 0.886 | −3.156 | −12.828 | 1.00 | 0.00 |
|------|------|------|------|----|--------|--------|---------|------|------|
| ATOM | 1097 | CG | GLN | 66 | 1.100 | −4.753 | −14.262 | 1.00 | 0.00 |
| ATOM | 1098 | 2HG | GLN | 66 | 0.442 | −5.395 | −14.848 | 1.00 | 0.00 |
| ATOM | 1099 | QG | GLN | 66 | 0.442 | −5.395 | −14.848 | 1.00 | 0.00 |
| ATOM | 1100 | CD | GLN | 66 | 2.177 | −4.154 | −15.169 | 1.00 | 0.00 |
| ATOM | 1101 | OE1 | GLN | 66 | 3.355 | −4.140 | −14.851 | 1.00 | 0.00 |
| ATOM | 1102 | NE2 | GLN | 66 | 1.709 | −3.660 | −16.310 | 1.00 | 0.00 |
| ATOM | 1103 | 1HE2 | GLN | 66 | 0.730 | −3.702 | −16.510 | 1.00 | 0.00 |
| ATOM | 1104 | 2HE2 | GLN | 66 | 2.336 | −3.245 | −16.970 | 1.00 | 0.00 |
| ATOM | 1105 | QE2 | GLN | 66 | 1.533 | −3.473 | −16.740 | 1.00 | 0.00 |
| ATOM | 1106 | C | GLN | 66 | −0.750 | −4.527 | −11.453 | 1.00 | 0.00 |
| ATOM | 1107 | O | GLN | 66 | −0.998 | −5.639 | −10.992 | 1.00 | 0.00 |
| ATOM | 1108 | N | LEU | 67 | −0.276 | −3.510 | −10.748 | 1.00 | 0.00 |
| ATOM | 1109 | H | LEU | 67 | −0.076 | −2.609 | −11.132 | 1.00 | 0.00 |
| ATOM | 1110 | CA | LEU | 67 | −0.007 | −3.647 | −9.326 | 1.00 | 0.00 |
| ATOM | 1111 | HA | LEU | 67 | −0.957 | −3.537 | −8.802 | 1.00 | 0.00 |
| ATOM | 1112 | CB | LEU | 67 | 0.522 | −5.048 | −9.013 | 1.00 | 0.00 |
| ATOM | 1113 | 2HB | LEU | 67 | −0.209 | −5.777 | −9.361 | 1.00 | 0.00 |
| ATOM | 1114 | QB | LEU | 67 | −0.209 | −5.777 | −9.361 | 1.00 | 0.00 |
| ATOM | 1115 | CG | LEU | 67 | 1.882 | −5.402 | −9.619 | 1.00 | 0.00 |
| ATOM | 1116 | HG | LEU | 67 | 2.099 | −6.445 | −9.385 | 1.00 | 0.00 |
| ATOM | 1117 | QD1 | LEU | 67 | 1.845 | −5.248 | −11.505 | 1.00 | 0.00 |
| ATOM | 1118 | QD2 | LEU | 67 | 3.260 | −4.358 | −8.847 | 1.00 | 0.00 |
| ATOM | 1119 | CD1 | LEU | 67 | 1.853 | −5.278 | −11.143 | 1.00 | 0.00 |
| ATOM | 1120 | 1HD1 | LEU | 67 | 2.827 | −5.548 | −11.548 | 1.00 | 0.00 |
| ATOM | 1121 | 2HD1 | LEU | 67 | 1.093 | −5.946 | −11.548 | 1.00 | 0.00 |
| ATOM | 1122 | 3HD1 | LEU | 67 | 1.616 | −4.249 | −11.419 | 1.00 | 0.00 |
| ATOM | 1123 | CD2 | LEU | 67 | 2.996 | −4.558 | −8.995 | 1.00 | 0.00 |
| ATOM | 1124 | 1HD2 | LEU | 67 | 3.442 | −3.925 | −9.761 | 1.00 | 0.00 |
| ATOM | 1125 | 2HD2 | LEU | 67 | 2.580 | −3.935 | −8.204 | 1.00 | 0.00 |
| ATOM | 1126 | 3HD2 | LEU | 67 | 3.758 | −5.216 | −8.578 | 1.00 | 0.00 |
| ATOM | 1127 | QQD | LEU | 67 | 2.553 | −4.803 | −10.176 | 1.00 | 0.00 |
| ATOM | 1128 | C | LEU | 67 | 0.928 | −2.522 | −8.878 | 1.00 | 0.00 |
| ATOM | 1129 | O | LEU | 67 | 0.712 | −1.911 | −7.832 | 1.00 | 0.00 |
| ATOM | 1130 | N | ASP− | 68 | 1.946 | −2.283 | −9.691 | 1.00 | 0.00 |
| ATOM | 1131 | H | ASP− | 68 | 2.114 | −2.785 | −10.540 | 1.00 | 0.00 |
| ATOM | 1132 | CA | ASP− | 68 | 2.915 | −1.242 | −9.391 | 1.00 | 0.00 |
| ATOM | 1133 | HA | ASP− | 68 | 3.331 | −1.510 | −8.420 | 1.00 | 0.00 |
| ATOM | 1134 | CB | ASP− | 68 | 4.013 | −1.189 | −10.454 | 1.00 | 0.00 |
| ATOM | 1135 | 2HB | ASP− | 68 | 3.792 | −0.374 | −11.144 | 1.00 | 0.00 |
| ATOM | 1136 | QB | ASP− | 68 | 3.792 | −0.374 | −11.144 | 1.00 | 0.00 |
| ATOM | 1137 | CG | ASP− | 68 | 5.431 | −0.998 | −9.911 | 1.00 | 0.00 |
| ATOM | 1138 | OD1 | ASP− | 68 | 5.855 | 0.175 | −9.831 | 1.00 | 0.00 |
| ATOM | 1139 | OD2 | ASP− | 68 | 6.058 | −2.030 | −9.588 | 1.00 | 0.00 |
| ATOM | 1140 | C | ASP− | 68 | 2.210 | 0.115 | −9.372 | 1.00 | 0.00 |
| ATOM | 1141 | O | ASP− | 68 | 2.146 | 0.771 | −8.334 | 1.00 | 0.00 |
| ATOM | 1142 | N | ASP− | 69 | 1.698 | 0.497 | −10.533 | 1.00 | 0.00 |
| ATOM | 1143 | H | ASP− | 69 | 1.755 | −0.042 | −11.373 | 1.00 | 0.00 |
| ATOM | 1144 | CA | ASP− | 69 | 0.999 | 1.764 | −10.663 | 1.00 | 0.00 |
| ATOM | 1145 | HA | ASP− | 69 | 1.673 | 2.507 | −10.236 | 1.00 | 0.00 |
| ATOM | 1146 | CB | ASP− | 69 | 0.702 | 2.081 | −12.129 | 1.00 | 0.00 |
| ATOM | 1147 | 2HB | ASP− | 69 | −0.025 | 2.892 | −12.170 | 1.00 | 0.00 |
| ATOM | 1148 | QB | ASP− | 69 | −0.025 | 2.892 | −12.170 | 1.00 | 0.00 |
| ATOM | 1149 | CG | ASP− | 69 | 1.921 | 2.476 | −12.966 | 1.00 | 0.00 |
| ATOM | 1150 | OD1 | ASP− | 69 | 1.778 | 2.491 | −14.207 | 1.00 | 0.00 |
| ATOM | 1151 | OD2 | ASP− | 69 | 2.970 | 2.753 | −12.344 | 1.00 | 0.00 |
| ATOM | 1152 | C | ASP− | 69 | −0.334 | 1.685 | −9.917 | 1.00 | 0.00 |
| ATOM | 1153 | O | ASP− | 69 | −0.834 | 2.695 | −9.422 | 1.00 | 0.00 |
| ATOM | 1154 | N | ASP− | 70 | −0.873 | 0.476 | −9.859 | 1.00 | 0.00 |
| ATOM | 1155 | H | ASP− | 70 | −0.460 | −0.340 | −10.263 | 1.00 | 0.00 |
| ATOM | 1156 | CA | ASP− | 70 | −2.139 | 0.253 | −9.181 | 1.00 | 0.00 |
| ATOM | 1157 | HA | ASP− | 70 | −2.893 | 0.700 | −9.829 | 1.00 | 0.00 |
| ATOM | 1158 | CB | ASP− | 70 | −2.405 | −1.242 | −8.991 | 1.00 | 0.00 |
| ATOM | 1159 | 2HB | ASP− | 70 | −1.932 | −1.565 | −8.064 | 1.00 | 0.00 |
| ATOM | 1160 | QB | ASP− | 70 | −1.932 | −1.565 | −8.064 | 1.00 | 0.00 |
| ATOM | 1161 | CG | ASP− | 70 | −3.882 | −1.635 | −8.948 | 1.00 | 0.00 |
| ATOM | 1162 | OD1 | ASP− | 70 | −4.162 | −2.825 | −9.210 | 1.00 | 0.00 |
| ATOM | 1163 | OD2 | ASP− | 70 | −4.700 | −0.737 | −8.653 | 1.00 | 0.00 |
| ATOM | 1164 | C | ASP− | 70 | −2.094 | 0.905 | −7.798 | 1.00 | 0.00 |
| ATOM | 1165 | O | ASP− | 70 | −3.091 | 1.457 | −7.335 | 1.00 | 0.00 |
| ATOM | 1166 | N | THR | 71 | −0.927 | 0.820 | −7.176 | 1.00 | 0.00 |
| ATOM | 1167 | H | THR | 71 | −0.120 | 0.369 | −7.559 | 1.00 | 0.00 |
| ATOM | 1168 | CA | THR | 71 | −0.739 | 1.395 | −5.855 | 1.00 | 0.00 |
| ATOM | 1169 | HA | THR | 71 | −1.644 | 1.938 | −5.584 | 1.00 | 0.00 |
| ATOM | 1170 | CB | THR | 71 | −0.518 | 0.247 | −4.867 | 1.00 | 0.00 |
| ATOM | 1171 | HB | THR | 71 | 0.189 | 0.535 | −4.089 | 1.00 | 0.00 |
| ATOM | 1172 | QG2 | THR | 71 | −2.137 | −0.381 | −4.113 | 1.00 | 0.00 |
| ATOM | 1173 | OG1 | THR | 71 | −0.073 | −0.832 | −5.683 | 1.00 | 0.00 |

TABLE 4-continued

Mistic-L Atomic Structure Coordinates

| ATOM | 1174 | 1HG | THR | 71 | 0.189 | −1.609 | −5.110 | 1.00 | 0.00 |
|---|---|---|---|---|---|---|---|---|---|
| ATOM | 1175 | CG2 | THR | 71 | −1.827 | −0.261 | −4.257 | 1.00 | 0.00 |
| ATOM | 1176 | 1HG2 | THR | 71 | −1.621 | −1.126 | −3.627 | 1.00 | 0.00 |
| ATOM | 1177 | 2HG2 | THR | 71 | −2.277 | 0.529 | −3.656 | 1.00 | 0.00 |
| ATOM | 1178 | 3HG2 | THR | 71 | −2.511 | −0.546 | −5.056 | 1.00 | 0.00 |
| ATOM | 1179 | C | THR | 71 | 0.405 | 2.409 | −5.873 | 1.00 | 0.00 |
| ATOM | 1180 | O | THR | 71 | 0.230 | 3.556 | −5.462 | 1.00 | 0.00 |
| ATOM | 1181 | N | ALA | 72 | 1.553 | 1.953 | −6.353 | 1.00 | 0.00 |
| ATOM | 1182 | H | ALA | 72 | 1.687 | 1.018 | −6.685 | 1.00 | 0.00 |
| ATOM | 1183 | CA | ALA | 72 | 2.726 | 2.806 | −6.430 | 1.00 | 0.00 |
| ATOM | 1184 | HA | ALA | 72 | 3.092 | 2.958 | −5.414 | 1.00 | 0.00 |
| ATOM | 1185 | QB | ALA | 72 | 4.072 | 1.941 | −7.441 | 1.00 | 0.00 |
| ATOM | 1186 | CB | ALA | 72 | 3.814 | 2.106 | −7.247 | 1.00 | 0.00 |
| ATOM | 1187 | 1HB | ALA | 72 | 3.632 | 2.269 | −8.309 | 1.00 | 0.00 |
| ATOM | 1188 | 2HB | ALA | 72 | 4.788 | 2.515 | −6.979 | 1.00 | 0.00 |
| ATOM | 1189 | 3HB | ALA | 72 | 3.796 | 1.038 | −7.034 | 1.00 | 0.00 |
| ATOM | 1190 | C | ALA | 72 | 2.329 | 4.158 | −7.026 | 1.00 | 0.00 |
| ATOM | 1191 | O | ALA | 72 | 2.774 | 5.203 | −6.554 | 1.00 | 0.00 |
| ATOM | 1192 | N | GLU− | 73 | 1.494 | 4.095 | −8.053 | 1.00 | 0.00 |
| ATOM | 1193 | H | GLU− | 73 | 1.135 | 3.240 | −8.430 | 1.00 | 0.00 |
| ATOM | 1194 | CA | GLU− | 73 | 1.032 | 5.301 | −8.717 | 1.00 | 0.00 |
| ATOM | 1195 | HA | GLU− | 73 | 1.933 | 5.792 | −9.085 | 1.00 | 0.00 |
| ATOM | 1196 | CB | GLU− | 73 | 0.125 | 4.962 | −9.901 | 1.00 | 0.00 |
| ATOM | 1197 | 2HB | GLU− | 73 | −0.891 | 4.789 | −9.549 | 1.00 | 0.00 |
| ATOM | 1198 | QB | GLU− | 73 | −0.891 | 4.789 | −9.549 | 1.00 | 0.00 |
| ATOM | 1199 | CG | GLU− | 73 | 0.128 | 6.090 | −10.935 | 1.00 | 0.00 |
| ATOM | 1200 | 2HG | GLU− | 73 | 0.852 | 5.868 | −11.719 | 1.00 | 0.00 |
| ATOM | 1201 | QG | GLU− | 73 | 0.852 | 5.868 | −11.719 | 1.00 | 0.00 |
| ATOM | 1202 | CD | GLU− | 73 | −1.260 | 6.270 | −11.553 | 1.00 | 0.00 |
| ATOM | 1203 | OE1 | GLU− | 73 | −1.307 | 6.680 | −12.733 | 1.00 | 0.00 |
| ATOM | 1204 | OE2 | GLU− | 73 | −2.243 | 5.995 | −10.831 | 1.00 | 0.00 |
| ATOM | 1205 | C | GLU− | 73 | 0.314 | 6.214 | −7.721 | 1.00 | 0.00 |
| ATOM | 1206 | O | GLU− | 73 | 0.282 | 7.431 | −7.899 | 1.00 | 0.00 |
| ATOM | 1207 | N | LEU | 74 | −0.246 | 5.592 | −6.694 | 1.00 | 0.00 |
| ATOM | 1208 | H | LEU | 74 | −0.216 | 4.601 | −6.557 | 1.00 | 0.00 |
| ATOM | 1209 | CA | LEU | 74 | −0.962 | 6.333 | −5.669 | 1.00 | 0.00 |
| ATOM | 1210 | HA | LEU | 74 | −1.516 | 7.127 | −6.168 | 1.00 | 0.00 |
| ATOM | 1211 | CB | LEU | 74 | −1.988 | 5.433 | −4.976 | 1.00 | 0.00 |
| ATOM | 1212 | 2HB | LEU | 74 | −1.786 | 5.446 | −3.905 | 1.00 | 0.00 |
| ATOM | 1213 | QB | LEU | 74 | −1.786 | 5.446 | −3.905 | 1.00 | 0.00 |
| ATOM | 1214 | CG | LEU | 74 | −3.457 | 5.799 | −5.196 | 1.00 | 0.00 |
| ATOM | 1215 | HG | LEU | 74 | −4.056 | 5.268 | −4.455 | 1.00 | 0.00 |
| ATOM | 1216 | QD1 | LEU | 74 | −3.744 | 7.650 | −4.922 | 1.00 | 0.00 |
| ATOM | 1217 | QD2 | LEU | 74 | −4.050 | 5.233 | −6.903 | 1.00 | 0.00 |
| ATOM | 1218 | CD1 | LEU | 74 | −3.689 | 7.295 | −4.974 | 1.00 | 0.00 |
| ATOM | 1219 | 1HD1 | LEU | 74 | −4.747 | 7.474 | −4.781 | 1.00 | 0.00 |
| ATOM | 1220 | 2HD1 | LEU | 74 | −3.101 | 7.631 | −4.121 | 1.00 | 0.00 |
| ATOM | 1221 | 3HD1 | LEU | 74 | −3.385 | 7.845 | −5.865 | 1.00 | 0.00 |
| ATOM | 1222 | CD2 | LEU | 74 | −3.936 | 5.342 | −6.575 | 1.00 | 0.00 |
| ATOM | 1223 | 1HD2 | LEU | 74 | −4.396 | 6.181 | −7.096 | 1.00 | 0.00 |
| ATOM | 1224 | 2HD2 | LEU | 74 | −3.086 | 4.978 | −7.153 | 1.00 | 0.00 |
| ATOM | 1225 | 3HD2 | LEU | 74 | −4.666 | 4.541 | −6.460 | 1.00 | 0.00 |
| ATOM | 1226 | QQD | LEU | 74 | −3.897 | 6.442 | −5.912 | 1.00 | 0.00 |
| ATOM | 1227 | C | LEU | 74 | 0.045 | 6.970 | −4.710 | 1.00 | 0.00 |
| ATOM | 1228 | O | LEU | 74 | 0.024 | 8.182 | −4.500 | 1.00 | 0.00 |
| ATOM | 1229 | N | MET | 75 | 0.902 | 6.126 | −4.155 | 1.00 | 0.00 |
| ATOM | 1230 | H | MET | 75 | 0.911 | 5.143 | −4.332 | 1.00 | 0.00 |
| ATOM | 1231 | CA | MET | 75 | 1.914 | 6.593 | −3.223 | 1.00 | 0.00 |
| ATOM | 1232 | HA | MET | 75 | 1.387 | 7.228 | −2.511 | 1.00 | 0.00 |
| ATOM | 1233 | CB | MET | 75 | 2.559 | 5.392 | −2.527 | 1.00 | 0.00 |
| ATOM | 1234 | 2HB | MET | 75 | 2.951 | 5.699 | −1.557 | 1.00 | 0.00 |
| ATOM | 1235 | QB | MET | 75 | 2.951 | 5.699 | −1.557 | 1.00 | 0.00 |
| ATOM | 1236 | CG | MET | 75 | 1.549 | 4.259 | −2.340 | 1.00 | 0.00 |
| ATOM | 1237 | 2HG | MET | 75 | 1.702 | 3.496 | −3.105 | 1.00 | 0.00 |
| ATOM | 1238 | QG | MET | 75 | 1.702 | 3.496 | −3.105 | 1.00 | 0.00 |
| ATOM | 1239 | SD | MET | 75 | 1.731 | 3.540 | −0.717 | 1.00 | 0.00 |
| ATOM | 1240 | QE | MET | 75 | 1.852 | 1.460 | −1.241 | 1.00 | 0.00 |
| ATOM | 1241 | CE | MET | 75 | 1.831 | 1.812 | −1.153 | 1.00 | 0.00 |
| ATOM | 1242 | 1HE | MET | 75 | 2.869 | 1.482 | −1.096 | 1.00 | 0.00 |
| ATOM | 1243 | 2HE | MET | 75 | 1.226 | 1.227 | −0.460 | 1.00 | 0.00 |
| ATOM | 1244 | 3HE | MET | 75 | 1.461 | 1.671 | −2.168 | 1.00 | 0.00 |
| ATOM | 1245 | C | MET | 75 | 2.991 | 7.405 | −3.945 | 1.00 | 0.00 |
| ATOM | 1246 | O | MET | 75 | 3.775 | 8.107 | −3.308 | 1.00 | 0.00 |
| ATOM | 1247 | N | LYS+ | 76 | 2.995 | 7.281 | −5.264 | 1.00 | 0.00 |
| ATOM | 1248 | H | LYS+ | 76 | 2.355 | 6.708 | −5.774 | 1.00 | 0.00 |
| ATOM | 1249 | CA | LYS+ | 76 | 3.964 | 7.994 | −6.080 | 1.00 | 0.00 |
| ATOM | 1250 | HA | LYS+ | 76 | 4.890 | 8.056 | −5.509 | 1.00 | 0.00 |
| ATOM | 1251 | CB | LYS+ | 76 | 4.271 | 7.209 | −7.356 | 1.00 | 0.00 |

TABLE 4-continued

Mistic-L Atomic Structure Coordinates

| ATOM | 1252 | 2HB | LYS+ | 76 | 3.347 | 7.016 | −7.901 | 1.00 | 0.00 |
|---|---|---|---|---|---|---|---|---|---|
| ATOM | 1253 | QB | LYS+ | 76 | 3.347 | 7.016 | −7.901 | 1.00 | 0.00 |
| ATOM | 1254 | CG | LYS+ | 76 | 5.245 | 7.978 | −8.251 | 1.00 | 0.00 |
| ATOM | 1255 | 2HG | LYS+ | 76 | 6.270 | 7.719 | −7.986 | 1.00 | 0.00 |
| ATOM | 1256 | QG | LYS+ | 76 | 6.270 | 7.719 | −7.986 | 1.00 | 0.00 |
| ATOM | 1257 | CD | LYS+ | 76 | 4.999 | 7.660 | −9.728 | 1.00 | 0.00 |
| ATOM | 1258 | 2HD | LYS+ | 76 | 3.949 | 7.827 | −9.970 | 1.00 | 0.00 |
| ATOM | 1259 | QD | LYS+ | 76 | 3.949 | 7.827 | −9.970 | 1.00 | 0.00 |
| ATOM | 1260 | CE | LYS+ | 76 | 5.880 | 8.530 | −10.629 | 1.00 | 0.00 |
| ATOM | 1261 | 2HE | LYS+ | 76 | 6.783 | 8.821 | −10.093 | 1.00 | 0.00 |
| ATOM | 1262 | QE | LYS+ | 76 | 6.783 | 8.821 | −10.093 | 1.00 | 0.00 |
| ATOM | 1263 | NZ | LYS+ | 76 | 6.243 | 7.796 | −11.862 | 1.00 | 0.00 |
| ATOM | 1264 | 1HZ | LYS+ | 76 | 7.186 | 7.472 | −11.792 | 1.00 | 0.00 |
| ATOM | 1265 | 2HZ | LYS+ | 76 | 5.630 | 7.014 | −11.977 | 1.00 | 0.00 |
| ATOM | 1266 | 3HZ | LYS+ | 76 | 6.157 | 8.406 | −12.650 | 1.00 | 0.00 |
| ATOM | 1267 | QZ | LYS+ | 76 | 6.324 | 7.631 | −12.140 | 1.00 | 0.00 |
| ATOM | 1268 | C | LYS+ | 76 | 3.458 | 9.415 | −6.338 | 1.00 | 0.00 |
| ATOM | 1269 | O | LYS+ | 76 | 4.175 | 10.386 | −6.101 | 1.00 | 0.00 |
| ATOM | 1270 | N | GLN | 77 | 2.226 | 9.492 | −6.820 | 1.00 | 0.00 |
| ATOM | 1271 | H | GLN | 77 | 1.649 | 8.697 | −7.011 | 1.00 | 0.00 |
| ATOM | 1272 | CA | GLN | 77 | 1.616 | 10.778 | −7.114 | 1.00 | 0.00 |
| ATOM | 1273 | HA | GLN | 77 | 2.267 | 11.245 | −7.854 | 1.00 | 0.00 |
| ATOM | 1274 | CB | GLN | 77 | 0.221 | 10.599 | −7.713 | 1.00 | 0.00 |
| ATOM | 1275 | 2HB | GLN | 77 | −0.525 | 11.028 | −7.044 | 1.00 | 0.00 |
| ATOM | 1276 | QB | GLN | 77 | −0.525 | 11.028 | −7.044 | 1.00 | 0.00 |
| ATOM | 1277 | CG | GLN | 77 | 0.124 | 11.266 | −9.087 | 1.00 | 0.00 |
| ATOM | 1278 | 2HG | GLN | 77 | −0.732 | 10.866 | −9.631 | 1.00 | 0.00 |
| ATOM | 1279 | QG | GLN | 77 | −0.732 | 10.866 | −9.631 | 1.00 | 0.00 |
| ATOM | 1280 | CD | GLN | 77 | −0.014 | 12.783 | −8.951 | 1.00 | 0.00 |
| ATOM | 1281 | OE1 | GLN | 77 | 0.924 | 13.492 | −8.625 | 1.00 | 0.00 |
| ATOM | 1282 | NE2 | GLN | 77 | −1.234 | 13.241 | −9.219 | 1.00 | 0.00 |
| ATOM | 1283 | 1HE2 | GLN | 77 | −1.960 | 12.606 | −9.481 | 1.00 | 0.00 |
| ATOM | 1284 | 2HE2 | GLN | 77 | −1.425 | 14.221 | −9.157 | 1.00 | 0.00 |
| ATOM | 1285 | QE2 | GLN | 77 | −1.693 | 13.413 | −9.319 | 1.00 | 0.00 |
| ATOM | 1286 | C | GLN | 77 | 1.564 | 11.640 | −5.852 | 1.00 | 0.00 |
| ATOM | 1287 | O | GLN | 77 | 1.732 | 12.857 | −5.919 | 1.00 | 0.00 |
| ATOM | 1288 | N | ALA | 78 | 1.330 | 10.977 | −4.729 | 1.00 | 0.00 |
| ATOM | 1289 | H | ALA | 78 | 1.196 | 9.987 | −4.682 | 1.00 | 0.00 |
| ATOM | 1290 | CA | ALA | 78 | 1.254 | 11.667 | −3.453 | 1.00 | 0.00 |
| ATOM | 1291 | HA | ALA | 78 | 0.696 | 12.591 | −3.608 | 1.00 | 0.00 |
| ATOM | 1292 | QB | ALA | 78 | 0.319 | 10.592 | −2.207 | 1.00 | 0.00 |
| ATOM | 1293 | CB | ALA | 78 | 0.498 | 10.798 | −2.446 | 1.00 | 0.00 |
| ATOM | 1294 | 1HB | ALA | 78 | 1.038 | 9.863 | −2.296 | 1.00 | 0.00 |
| ATOM | 1295 | 2HB | ALA | 78 | 0.419 | 11.328 | −1.497 | 1.00 | 0.00 |
| ATOM | 1296 | 3HB | ALA | 78 | −0.500 | 10.585 | −2.828 | 1.00 | 0.00 |
| ATOM | 1297 | C | ALA | 78 | 2.667 | 12.014 | −2.980 | 1.00 | 0.00 |
| ATOM | 1298 | O | ALA | 78 | 2.954 | 13.167 | −2.660 | 1.00 | 0.00 |
| ATOM | 1299 | N | ARG+ | 79 | 3.513 | 10.994 | −2.949 | 1.00 | 0.00 |
| ATOM | 1300 | H | ARG+ | 79 | 3.272 | 10.060 | −3.211 | 1.00 | 0.00 |
| ATOM | 1301 | CA | ARG+ | 79 | 4.890 | 11.176 | −2.521 | 1.00 | 0.00 |
| ATOM | 1302 | HA | ARG+ | 79 | 4.817 | 11.702 | −1.568 | 1.00 | 0.00 |
| ATOM | 1303 | CB | ARG+ | 79 | 5.590 | 9.829 | −2.331 | 1.00 | 0.00 |
| ATOM | 1304 | 2HB | ARG+ | 79 | 4.912 | 9.128 | −1.845 | 1.00 | 0.00 |
| ATOM | 1305 | QB | ARG+ | 79 | 4.912 | 9.128 | −1.845 | 1.00 | 0.00 |
| ATOM | 1306 | CG | ARG+ | 79 | 6.048 | 9.256 | −3.674 | 1.00 | 0.00 |
| ATOM | 1307 | 2HG | ARG+ | 79 | 5.426 | 9.655 | −4.475 | 1.00 | 0.00 |
| ATOM | 1308 | QG | ARG+ | 79 | 5.426 | 9.655 | −4.475 | 1.00 | 0.00 |
| ATOM | 1309 | CD | ARG+ | 79 | 7.516 | 9.595 | −3.942 | 1.00 | 0.00 |
| ATOM | 1310 | 2HD | ARG+ | 79 | 7.853 | 10.363 | −3.247 | 1.00 | 0.00 |
| ATOM | 1311 | QD | ARG+ | 79 | 7.853 | 10.363 | −3.247 | 1.00 | 0.00 |
| ATOM | 1312 | NE | ARG+ | 79 | 8.351 | 8.381 | −3.797 | 1.00 | 0.00 |
| ATOM | 1313 | HE | ARG+ | 79 | 8.977 | 8.333 | −3.020 | 1.00 | 0.00 |
| ATOM | 1314 | CZ | ARG+ | 79 | 8.318 | 7.342 | −4.643 | 1.00 | 0.00 |
| ATOM | 1315 | NH1 | ARG+ | 79 | 9.111 | 6.282 | −4.433 | 1.00 | 0.00 |
| ATOM | 1316 | 1HH1 | ARG+ | 79 | 9.087 | 5.507 | −5.064 | 1.00 | 0.00 |
| ATOM | 1317 | 2HH1 | ARG+ | 79 | 9.727 | 6.267 | −3.644 | 1.00 | 0.00 |
| ATOM | 1318 | QH1 | ARG+ | 79 | 9.407 | 5.887 | −4.354 | 1.00 | 0.00 |
| ATOM | 1319 | NH2 | ARG+ | 79 | 7.493 | 7.362 | −5.698 | 1.00 | 0.00 |
| ATOM | 1320 | 1HH2 | ARG+ | 79 | 7.469 | 6.587 | −6.330 | 1.00 | 0.00 |
| ATOM | 1321 | 2HH2 | ARG+ | 79 | 6.902 | 8.153 | −5.856 | 1.00 | 0.00 |
| ATOM | 1322 | QH2 | ARG+ | 79 | 7.186 | 7.370 | −6.093 | 1.00 | 0.00 |
| ATOM | 1323 | C | ARG+ | 79 | 5.661 | 12.004 | −3.550 | 1.00 | 0.00 |
| ATOM | 1324 | O | ARG+ | 79 | 6.830 | 12.326 | −3.343 | 1.00 | 0.00 |
| ATOM | 1325 | N | ASP− | 80 | 4.976 | 12.325 | −4.637 | 1.00 | 0.00 |
| ATOM | 1326 | H | ASP− | 80 | 4.026 | 12.059 | −4.798 | 1.00 | 0.00 |
| ATOM | 1327 | CA | ASP− | 80 | 5.583 | 13.110 | −5.699 | 1.00 | 0.00 |
| ATOM | 1328 | HA | ASP− | 80 | 6.635 | 13.197 | −5.426 | 1.00 | 0.00 |
| ATOM | 1329 | CB | ASP− | 80 | 5.431 | 12.414 | −7.054 | 1.00 | 0.00 |

TABLE 4-continued

Mistic-L Atomic Structure Coordinates

| ATOM | 1330 | 2HB | ASP- | 80 | 4.371 | 12.247 | -7.243 | 1.00 | 0.00 |
| ATOM | 1331 | QB | ASP- | 80 | 4.371 | 12.247 | -7.243 | 1.00 | 0.00 |
| ATOM | 1332 | CG | ASP- | 80 | 6.025 | 13.174 | -8.242 | 1.00 | 0.00 |
| ATOM | 1333 | OD1 | ASP- | 80 | 7.154 | 12.814 | -8.639 | 1.00 | 0.00 |
| ATOM | 1334 | OD2 | ASP- | 80 | 5.336 | 14.098 | -8.725 | 1.00 | 0.00 |
| ATOM | 1335 | C | ASP- | 80 | 4.886 | 14.469 | -5.786 | 1.00 | 0.00 |
| ATOM | 1336 | O | ASP- | 80 | 5.437 | 15.419 | -6.339 | 1.00 | 0.00 |
| ATOM | 1337 | N | MET | 81 | 3.684 | 14.518 | -5.229 | 1.00 | 0.00 |
| ATOM | 1338 | H | MET | 81 | 3.243 | 13.741 | -4.781 | 1.00 | 0.00 |
| ATOM | 1339 | CA | MET | 81 | 2.907 | 15.745 | -5.237 | 1.00 | 0.00 |
| ATOM | 1340 | HA | MET | 81 | 3.321 | 16.350 | -6.043 | 1.00 | 0.00 |
| ATOM | 1341 | CB | MET | 81 | 1.434 | 15.415 | -5.488 | 1.00 | 0.00 |
| ATOM | 1342 | 2HB | MET | 81 | 1.109 | 14.636 | -4.799 | 1.00 | 0.00 |
| ATOM | 1343 | QB | MET | 81 | 1.109 | 14.636 | -4.799 | 1.00 | 0.00 |
| ATOM | 1344 | CG | MET | 81 | 0.556 | 16.656 | -5.313 | 1.00 | 0.00 |
| ATOM | 1345 | 2HG | MET | 81 | 1.141 | 17.467 | -4.880 | 1.00 | 0.00 |
| ATOM | 1346 | QG | MET | 81 | 1.141 | 17.467 | -4.880 | 1.00 | 0.00 |
| ATOM | 1347 | SD | MET | 81 | -0.111 | 17.160 | -6.891 | 1.00 | 0.00 |
| ATOM | 1348 | QE | MET | 81 | -2.050 | 16.243 | -6.787 | 1.00 | 0.00 |
| ATOM | 1349 | CE | MET | 81 | -1.722 | 16.398 | -6.804 | 1.00 | 0.00 |
| ATOM | 1350 | 1HE | MET | 81 | -2.046 | 16.351 | -5.765 | 1.00 | 0.00 |
| ATOM | 1351 | 2HE | MET | 81 | -2.435 | 16.988 | -7.381 | 1.00 | 0.00 |
| ATOM | 1352 | 3HE | MET | 81 | -1.670 | 15.389 | -7.214 | 1.00 | 0.00 |
| ATOM | 1353 | C | MET | 81 | 3.043 | 16.489 | -3.906 | 1.00 | 0.00 |
| ATOM | 1354 | O | MET | 81 | 3.275 | 17.696 | -3.887 | 1.00 | 0.00 |
| ATOM | 1355 | N | TYR | 82 | 2.893 | 15.736 | -2.826 | 1.00 | 0.00 |
| ATOM | 1356 | H | TYR | 82 | 2.705 | 14.754 | -2.851 | 1.00 | 0.00 |
| ATOM | 1357 | CA | TYR | 82 | 2.997 | 16.308 | -1.495 | 1.00 | 0.00 |
| ATOM | 1358 | HA | TYR | 82 | 3.381 | 17.324 | -1.594 | 1.00 | 0.00 |
| ATOM | 1359 | CB | TYR | 82 | 1.592 | 16.236 | -0.894 | 1.00 | 0.00 |
| ATOM | 1360 | 2HB | TYR | 82 | 1.663 | 15.856 | 0.125 | 1.00 | 0.00 |
| ATOM | 1361 | QB | TYR | 82 | 1.663 | 15.856 | 0.125 | 1.00 | 0.00 |
| ATOM | 1362 | QD | TYR | 82 | 0.784 | 17.703 | -0.871 | 1.00 | 0.00 |
| ATOM | 1363 | QE | TYR | 82 | -0.443 | 19.929 | -0.836 | 1.00 | 0.00 |
| ATOM | 1364 | QR | TYR | 82 | 0.170 | 18.816 | -0.854 | 1.00 | 0.00 |
| ATOM | 1365 | CG | TYR | 82 | 0.854 | 17.575 | -0.873 | 1.00 | 0.00 |
| ATOM | 1366 | CD1 | TYR | 82 | -0.487 | 17.630 | -1.197 | 1.00 | 0.00 |
| ATOM | 1367 | 1HD | TYR | 82 | -1.019 | 16.719 | -1.467 | 1.00 | 0.00 |
| ATOM | 1368 | CE1 | TYR | 82 | -1.182 | 18.891 | -1.176 | 1.00 | 0.00 |
| ATOM | 1369 | 1HE | TYR | 82 | -2.240 | 18.948 | -1.430 | 1.00 | 0.00 |
| ATOM | 1370 | CZ | TYR | 82 | -0.487 | 20.009 | -0.835 | 1.00 | 0.00 |
| ATOM | 1371 | CE2 | TYR | 82 | 0.834 | 19.991 | -0.510 | 1.00 | 0.00 |
| ATOM | 1372 | 2HE | TYR | 82 | 1.354 | 20.910 | -0.242 | 1.00 | 0.00 |
| ATOM | 1373 | CD2 | TYR | 82 | 1.528 | 18.729 | -0.531 | 1.00 | 0.00 |
| ATOM | 1374 | 2HD | TYR | 82 | 2.587 | 18.686 | -0.274 | 1.00 | 0.00 |
| ATOM | 1375 | OH | TYR | 82 | -1.143 | 21.201 | -0.816 | 1.00 | 0.00 |
| ATOM | 1376 | HH | TYR | 82 | -0.627 | 21.883 | -1.333 | 1.00 | 0.00 |
| ATOM | 1377 | C | TYR | 82 | 3.955 | 15.495 | -0.621 | 1.00 | 0.00 |
| ATOM | 1378 | O | TYR | 82 | 4.802 | 16.060 | 0.069 | 1.00 | 0.00 |
| ATOM | 1379 | N | GLY | 83 | 3.790 | 14.182 | -0.682 | 1.00 | 0.00 |
| ATOM | 1380 | H | GLY | 83 | 3.100 | 13.731 | -1.247 | 1.00 | 0.00 |
| ATOM | 1381 | CA | GLY | 83 | 4.630 | 13.286 | 0.095 | 1.00 | 0.00 |
| ATOM | 1382 | 1HA | GLY | 83 | 5.577 | 13.129 | -0.423 | 1.00 | 0.00 |
| ATOM | 1383 | 2HA | GLY | 83 | 4.864 | 13.743 | 1.056 | 1.00 | 0.00 |
| ATOM | 1384 | QA | GLY | 83 | 5.220 | 13.436 | 0.317 | 1.00 | 0.00 |
| ATOM | 1385 | C | GLY | 83 | 3.936 | 11.941 | 0.318 | 1.00 | 0.00 |
| ATOM | 1386 | O | GLY | 83 | 4.594 | 10.933 | 0.567 | 1.00 | 0.00 |
| ATOM | 1387 | N | GLN | 84 | 2.614 | 11.970 | 0.222 | 1.00 | 0.00 |
| ATOM | 1388 | H | GLN | 84 | 2.087 | 12.794 | 0.020 | 1.00 | 0.00 |
| ATOM | 1389 | CA | GLN | 84 | 1.824 | 10.766 | 0.412 | 1.00 | 0.00 |
| ATOM | 1390 | HA | GLN | 84 | 1.783 | 10.290 | -0.568 | 1.00 | 0.00 |
| ATOM | 1391 | CB | GLN | 84 | 2.501 | 9.815 | 1.401 | 1.00 | 0.00 |
| ATOM | 1392 | 2HB | GLN | 84 | 2.863 | 10.378 | 2.262 | 1.00 | 0.00 |
| ATOM | 1393 | QB | GLN | 84 | 2.863 | 10.378 | 2.262 | 1.00 | 0.00 |
| ATOM | 1394 | CG | GLN | 84 | 1.531 | 8.728 | 1.868 | 1.00 | 0.00 |
| ATOM | 1395 | 2HG | GLN | 84 | 0.637 | 9.188 | 2.289 | 1.00 | 0.00 |
| ATOM | 1396 | QG | GLN | 84 | 0.637 | 9.188 | 2.289 | 1.00 | 0.00 |
| ATOM | 1397 | CD | GLN | 84 | 1.140 | 7.807 | 0.710 | 1.00 | 0.00 |
| ATOM | 1398 | OE1 | GLN | 84 | 1.605 | 7.945 | -0.410 | 1.00 | 0.00 |
| ATOM | 1399 | NE2 | GLN | 84 | 0.263 | 6.863 | 1.041 | 1.00 | 0.00 |
| ATOM | 1400 | 1HE2 | GLN | 84 | -0.078 | 6.805 | 1.979 | 1.00 | 0.00 |
| ATOM | 1401 | 2HE2 | GLN | 84 | -0.054 | 6.213 | 0.351 | 1.00 | 0.00 |
| ATOM | 1402 | QE2 | GLN | 84 | -0.066 | 6.509 | 1.165 | 1.00 | 0.00 |
| ATOM | 1403 | C | GLN | 84 | 0.411 | 11.125 | 0.876 | 1.00 | 0.00 |
| ATOM | 1404 | O | GLN | 84 | -0.545 | 10.412 | 0.575 | 1.00 | 0.00 |
| ATOM | 1405 | N | GLU- | 85 | 0.325 | 12.231 | 1.600 | 1.00 | 0.00 |
| ATOM | 1406 | H | GLU- | 85 | 1.107 | 12.805 | 1.840 | 1.00 | 0.00 |
| ATOM | 1407 | CA | GLU- | 85 | -0.956 | 12.694 | 2.109 | 1.00 | 0.00 |

TABLE 4-continued

Mistic-L Atomic Structure Coordinates

| ATOM | 1408 | HA | GLU− | 85 | −1.617 | 12.723 | 1.244 | 1.00 | 0.00 |
|------|------|------|------|----|--------|--------|-------|------|------|
| ATOM | 1409 | CB | GLU− | 85 | −1.523 | 11.716 | 3.140 | 1.00 | 0.00 |
| ATOM | 1410 | 2HB | GLU− | 85 | −0.810 | 11.589 | 3.956 | 1.00 | 0.00 |
| ATOM | 1411 | QB | GLU− | 85 | −0.810 | 11.589 | 3.956 | 1.00 | 0.00 |
| ATOM | 1412 | CG | GLU− | 85 | −2.858 | 12.216 | 3.695 | 1.00 | 0.00 |
| ATOM | 1413 | 2HG | GLU− | 85 | −3.573 | 11.394 | 3.726 | 1.00 | 0.00 |
| ATOM | 1414 | QG | GLU− | 85 | −3.573 | 11.394 | 3.726 | 1.00 | 0.00 |
| ATOM | 1415 | CD | GLU− | 85 | −2.684 | 12.804 | 5.097 | 1.00 | 0.00 |
| ATOM | 1416 | OE1 | GLU− | 85 | −1.696 | 12.415 | 5.756 | 1.00 | 0.00 |
| ATOM | 1417 | OE2 | GLU− | 85 | −3.543 | 13.628 | 5.477 | 1.00 | 0.00 |
| ATOM | 1418 | C | GLU− | 85 | −0.815 | 14.096 | 2.703 | 1.00 | 0.00 |
| ATOM | 1419 | O | GLU− | 85 | −1.619 | 14.504 | 3.539 | 1.00 | 0.00 |
| ATOM | 1420 | N | LYS+ | 86 | 0.213 | 14.797 | 2.247 | 1.00 | 0.00 |
| ATOM | 1421 | H | LYS+ | 86 | 0.863 | 14.459 | 1.566 | 1.00 | 0.00 |
| ATOM | 1422 | CA | LYS+ | 86 | 0.470 | 16.146 | 2.723 | 1.00 | 0.00 |
| ATOM | 1423 | HA | LYS+ | 86 | 1.228 | 16.583 | 2.073 | 1.00 | 0.00 |
| ATOM | 1424 | CB | LYS+ | 86 | −0.788 | 17.008 | 2.594 | 1.00 | 0.00 |
| ATOM | 1425 | 2HB | LYS+ | 86 | −1.384 | 16.926 | 3.503 | 1.00 | 0.00 |
| ATOM | 1426 | QB | LYS+ | 86 | −1.384 | 16.926 | 3.503 | 1.00 | 0.00 |
| ATOM | 1427 | CG | LYS+ | 86 | −0.425 | 18.474 | 2.346 | 1.00 | 0.00 |
| ATOM | 1428 | 2HG | LYS+ | 86 | −0.435 | 18.678 | 1.276 | 1.00 | 0.00 |
| ATOM | 1429 | QG | LYS+ | 86 | −0.435 | 18.678 | 1.276 | 1.00 | 0.00 |
| ATOM | 1430 | CD | LYS+ | 86 | −1.404 | 19.408 | 3.059 | 1.00 | 0.00 |
| ATOM | 1431 | 2HD | LYS+ | 86 | −2.265 | 18.840 | 3.409 | 1.00 | 0.00 |
| ATOM | 1432 | QD | LYS+ | 86 | −2.265 | 18.840 | 3.409 | 1.00 | 0.00 |
| ATOM | 1433 | CE | LYS+ | 86 | −0.732 | 20.108 | 4.242 | 1.00 | 0.00 |
| ATOM | 1434 | 2HE | LYS+ | 86 | 0.352 | 20.040 | 4.144 | 1.00 | 0.00 |
| ATOM | 1435 | QE | LYS+ | 86 | 0.352 | 20.040 | 4.144 | 1.00 | 0.00 |
| ATOM | 1436 | NZ | LYS+ | 86 | −1.141 | 21.529 | 4.305 | 1.00 | 0.00 |
| ATOM | 1437 | 1HZ | LYS+ | 86 | −2.111 | 21.606 | 4.074 | 1.00 | 0.00 |
| ATOM | 1438 | 2HZ | LYS+ | 86 | −0.989 | 21.879 | 5.230 | 1.00 | 0.00 |
| ATOM | 1439 | 3HZ | LYS+ | 86 | −0.600 | 22.061 | 3.654 | 1.00 | 0.00 |
| ATOM | 1440 | QZ | LYS+ | 86 | −1.233 | 21.849 | 4.319 | 1.00 | 0.00 |
| ATOM | 1441 | C | LYS+ | 86 | 1.029 | 16.083 | 4.146 | 1.00 | 0.00 |
| ATOM | 1442 | O | LYS+ | 86 | 1.010 | 17.077 | 4.868 | 1.00 | 0.00 |
| ATOM | 1443 | N | LEU | 87 | 1.512 | 14.903 | 4.505 | 1.00 | 0.00 |
| ATOM | 1444 | H | LEU | 87 | 1.524 | 14.098 | 3.911 | 1.00 | 0.00 |
| ATOM | 1445 | CA | LEU | 87 | 2.075 | 14.696 | 5.828 | 1.00 | 0.00 |
| ATOM | 1446 | HA | LEU | 87 | 2.127 | 15.669 | 6.317 | 1.00 | 0.00 |
| ATOM | 1447 | CB | LEU | 87 | 1.152 | 13.816 | 6.672 | 1.00 | 0.00 |
| ATOM | 1448 | 2HB | LEU | 87 | 1.130 | 12.819 | 6.231 | 1.00 | 0.00 |
| ATOM | 1449 | QB | LEU | 87 | 1.130 | 12.819 | 6.231 | 1.00 | 0.00 |
| ATOM | 1450 | CG | LEU | 87 | 1.520 | 13.680 | 8.151 | 1.00 | 0.00 |
| ATOM | 1451 | HG | LEU | 87 | 2.608 | 13.678 | 8.234 | 1.00 | 0.00 |
| ATOM | 1452 | QD1 | LEU | 87 | 0.887 | 15.161 | 9.147 | 1.00 | 0.00 |
| ATOM | 1453 | QD2 | LEU | 87 | 0.904 | 12.035 | 8.857 | 1.00 | 0.00 |
| ATOM | 1454 | CD1 | LEU | 87 | 1.008 | 14.876 | 8.955 | 1.00 | 0.00 |
| ATOM | 1455 | 1HD1 | LEU | 87 | 1.809 | 15.256 | 9.592 | 1.00 | 0.00 |
| ATOM | 1456 | 2HD1 | LEU | 87 | 0.684 | 15.662 | 8.273 | 1.00 | 0.00 |
| ATOM | 1457 | 3HD1 | LEU | 87 | 0.168 | 14.565 | 9.575 | 1.00 | 0.00 |
| ATOM | 1458 | CD2 | LEU | 87 | 1.023 | 12.351 | 8.721 | 1.00 | 0.00 |
| ATOM | 1459 | 1HD2 | LEU | 87 | −0.067 | 12.327 | 8.689 | 1.00 | 0.00 |
| ATOM | 1460 | 2HD2 | LEU | 87 | 1.421 | 11.528 | 8.127 | 1.00 | 0.00 |
| ATOM | 1461 | 3HD2 | LEU | 87 | 1.357 | 12.249 | 9.754 | 1.00 | 0.00 |
| ATOM | 1462 | QQD | LEU | 87 | 0.895 | 13.598 | 9.002 | 1.00 | 0.00 |
| ATOM | 1463 | C | LEU | 87 | 3.496 | 14.145 | 5.693 | 1.00 | 0.00 |
| ATOM | 1464 | O | LEU | 87 | 4.093 | 13.708 | 6.677 | 1.00 | 0.00 |
| ATOM | 1465 | N | ASN | 88 | 3.997 | 14.184 | 4.468 | 1.00 | 0.00 |
| ATOM | 1466 | H | ASN | 88 | 3.506 | 14.541 | 3.673 | 1.00 | 0.00 |
| ATOM | 1467 | CA | ASN | 88 | 5.337 | 13.694 | 4.192 | 1.00 | 0.00 |
| ATOM | 1468 | HA | ASN | 88 | 5.210 | 12.642 | 3.935 | 1.00 | 0.00 |
| ATOM | 1469 | CB | ASN | 88 | 5.976 | 14.461 | 3.031 | 1.00 | 0.00 |
| ATOM | 1470 | 2HB | ASN | 88 | 6.212 | 13.771 | 2.221 | 1.00 | 0.00 |
| ATOM | 1471 | QB | ASN | 88 | 6.212 | 13.771 | 2.221 | 1.00 | 0.00 |
| ATOM | 1472 | CG | ASN | 88 | 5.040 | 15.557 | 2.517 | 1.00 | 0.00 |
| ATOM | 1473 | OD1 | ASN | 88 | 3.877 | 15.330 | 2.226 | 1.00 | 0.00 |
| ATOM | 1474 | ND2 | ASN | 88 | 5.611 | 16.754 | 2.423 | 1.00 | 0.00 |
| ATOM | 1475 | 1HD2 | ASN | 88 | 6.571 | 16.872 | 2.678 | 1.00 | 0.00 |
| ATOM | 1476 | 2HD2 | ASN | 88 | 5.081 | 17.537 | 2.097 | 1.00 | 0.00 |
| ATOM | 1477 | QD2 | ASN | 88 | 5.826 | 17.204 | 2.387 | 1.00 | 0.00 |
| ATOM | 1478 | C | ASN | 88 | 6.215 | 13.893 | 5.429 | 1.00 | 0.00 |
| ATOM | 1479 | O | ASN | 88 | 6.956 | 12.994 | 5.820 | 1.00 | 0.00 |
| ATOM | 1480 | N | GLU− | 89 | 6.100 | 15.078 | 6.011 | 1.00 | 0.00 |
| ATOM | 1481 | H | GLU− | 89 | 5.494 | 15.804 | 5.686 | 1.00 | 0.00 |
| ATOM | 1482 | CA | GLU− | 89 | 6.873 | 15.407 | 7.196 | 1.00 | 0.00 |
| ATOM | 1483 | HA | GLU− | 89 | 7.869 | 15.660 | 6.832 | 1.00 | 0.00 |
| ATOM | 1484 | CB | GLU− | 89 | 6.281 | 16.620 | 7.918 | 1.00 | 0.00 |
| ATOM | 1485 | 2HB | GLU− | 89 | 6.337 | 16.469 | 8.996 | 1.00 | 0.00 |

TABLE 4-continued

Mistic-L Atomic Structure Coordinates

| ATOM | 1486 | QB | GLU− | 89 | 6.337 | 16.469 | 8.996 | 1.00 | 0.00 |
|---|---|---|---|---|---|---|---|---|---|
| ATOM | 1487 | CG | GLU− | 89 | 7.025 | 17.901 | 7.537 | 1.00 | 0.00 |
| ATOM | 1488 | 2HG | GLU− | 89 | 6.307 | 18.684 | 7.291 | 1.00 | 0.00 |
| ATOM | 1489 | QG | GLU− | 89 | 6.307 | 18.684 | 7.291 | 1.00 | 0.00 |
| ATOM | 1490 | CD | GLU− | 89 | 7.929 | 18.371 | 8.680 | 1.00 | 0.00 |
| ATOM | 1491 | OE1 | GLU− | 89 | 7.430 | 18.389 | 9.826 | 1.00 | 0.00 |
| ATOM | 1492 | OE2 | GLU− | 89 | 9.096 | 18.702 | 8.381 | 1.00 | 0.00 |
| ATOM | 1493 | C | GLU− | 89 | 6.953 | 14.199 | 8.131 | 1.00 | 0.00 |
| ATOM | 1494 | O | GLU− | 89 | 8.026 | 13.867 | 8.633 | 1.00 | 0.00 |
| ATOM | 1495 | N | LYS+ | 90 | 5.804 | 13.571 | 8.335 | 1.00 | 0.00 |
| ATOM | 1496 | H | LYS+ | 90 | 4.935 | 13.847 | 7.922 | 1.00 | 0.00 |
| ATOM | 1497 | CA | LYS+ | 90 | 5.730 | 12.406 | 9.200 | 1.00 | 0.00 |
| ATOM | 1498 | HA | LYS+ | 90 | 6.722 | 12.251 | 9.623 | 1.00 | 0.00 |
| ATOM | 1499 | CB | LYS+ | 90 | 4.775 | 12.666 | 10.367 | 1.00 | 0.00 |
| ATOM | 1500 | 2HB | LYS+ | 90 | 3.924 | 11.986 | 10.303 | 1.00 | 0.00 |
| ATOM | 1501 | QB | LYS+ | 90 | 3.924 | 11.986 | 10.303 | 1.00 | 0.00 |
| ATOM | 1502 | CG | LYS+ | 90 | 5.485 | 12.477 | 11.709 | 1.00 | 0.00 |
| ATOM | 1503 | 2HG | LYS+ | 90 | 6.030 | 11.532 | 11.706 | 1.00 | 0.00 |
| ATOM | 1504 | QG | LYS+ | 90 | 6.030 | 11.532 | 11.706 | 1.00 | 0.00 |
| ATOM | 1505 | CD | LYS+ | 90 | 6.453 | 13.629 | 11.985 | 1.00 | 0.00 |
| ATOM | 1506 | 2HD | LYS+ | 90 | 5.892 | 14.519 | 12.270 | 1.00 | 0.00 |
| ATOM | 1507 | QD | LYS+ | 90 | 5.892 | 14.519 | 12.270 | 1.00 | 0.00 |
| ATOM | 1508 | CE | LYS+ | 90 | 7.439 | 13.263 | 13.096 | 1.00 | 0.00 |
| ATOM | 1509 | 2HE | LYS+ | 90 | 7.270 | 12.235 | 13.415 | 1.00 | 0.00 |
| ATOM | 1510 | QE | LYS+ | 90 | 7.270 | 12.235 | 13.415 | 1.00 | 0.00 |
| ATOM | 1511 | NZ | LYS+ | 90 | 8.833 | 13.421 | 12.624 | 1.00 | 0.00 |
| ATOM | 1512 | 1HZ | LYS+ | 90 | 8.915 | 13.052 | 11.699 | 1.00 | 0.00 |
| ATOM | 1513 | 2HZ | LYS+ | 90 | 9.075 | 14.392 | 12.618 | 1.00 | 0.00 |
| ATOM | 1514 | 3HZ | LYS+ | 90 | 9.450 | 12.928 | 13.237 | 1.00 | 0.00 |
| ATOM | 1515 | QZ | LYS+ | 90 | 9.147 | 13.457 | 12.518 | 1.00 | 0.00 |
| ATOM | 1516 | C | LYS+ | 90 | 5.361 | 11.179 | 8.364 | 1.00 | 0.00 |
| ATOM | 1517 | O | LYS+ | 90 | 5.516 | 10.046 | 8.817 | 1.00 | 0.00 |
| ATOM | 1518 | N | LEU | 91 | 4.880 | 11.446 | 7.159 | 1.00 | 0.00 |
| ATOM | 1519 | H | LEU | 91 | 4.758 | 12.371 | 6.798 | 1.00 | 0.00 |
| ATOM | 1520 | CA | LEU | 91 | 4.488 | 10.377 | 6.256 | 1.00 | 0.00 |
| ATOM | 1521 | HA | LEU | 91 | 3.794 | 9.733 | 6.795 | 1.00 | 0.00 |
| ATOM | 1522 | CB | LEU | 91 | 3.738 | 10.943 | 5.050 | 1.00 | 0.00 |
| ATOM | 1523 | 2HB | LEU | 91 | 4.191 | 10.543 | 4.143 | 1.00 | 0.00 |
| ATOM | 1524 | QB | LEU | 91 | 4.191 | 10.543 | 4.143 | 1.00 | 0.00 |
| ATOM | 1525 | CG | LEU | 91 | 2.234 | 10.661 | 5.002 | 1.00 | 0.00 |
| ATOM | 1526 | HG | LEU | 91 | 1.800 | 10.961 | 5.956 | 1.00 | 0.00 |
| ATOM | 1527 | QD1 | LEU | 91 | 1.392 | 11.691 | 3.656 | 1.00 | 0.00 |
| ATOM | 1528 | QD2 | LEU | 91 | 1.898 | 8.809 | 4.793 | 1.00 | 0.00 |
| ATOM | 1529 | CD1 | LEU | 91 | 1.553 | 11.494 | 3.914 | 1.00 | 0.00 |
| ATOM | 1530 | 1HD1 | LEU | 91 | 0.959 | 12.281 | 4.377 | 1.00 | 0.00 |
| ATOM | 1531 | 2HD1 | LEU | 91 | 2.312 | 11.941 | 3.272 | 1.00 | 0.00 |
| ATOM | 1532 | 3HD1 | LEU | 91 | 0.905 | 10.852 | 3.317 | 1.00 | 0.00 |
| ATOM | 1533 | CD2 | LEU | 91 | 1.962 | 9.165 | 4.833 | 1.00 | 0.00 |
| ATOM | 1534 | 1HD2 | LEU | 91 | 2.827 | 8.688 | 4.370 | 1.00 | 0.00 |
| ATOM | 1535 | 2HD2 | LEU | 91 | 1.780 | 8.716 | 5.809 | 1.00 | 0.00 |
| ATOM | 1536 | 3HD2 | LEU | 91 | 1.087 | 9.024 | 4.199 | 1.00 | 0.00 |
| ATOM | 1537 | QQD | LEU | 91 | 1.645 | 10.250 | 4.224 | 1.00 | 0.00 |
| ATOM | 1538 | C | LEU | 91 | 5.723 | 9.554 | 5.881 | 1.00 | 0.00 |
| ATOM | 1539 | O | LEU | 91 | 5.681 | 8.324 | 5.895 | 1.00 | 0.00 |
| ATOM | 1540 | N | ASN | 92 | 6.792 | 10.265 | 5.556 | 1.00 | 0.00 |
| ATOM | 1541 | H | ASN | 92 | 6.818 | 11.265 | 5.547 | 1.00 | 0.00 |
| ATOM | 1542 | CA | ASN | 92 | 8.036 | 9.616 | 5.177 | 1.00 | 0.00 |
| ATOM | 1543 | HA | ASN | 92 | 7.933 | 9.395 | 4.115 | 1.00 | 0.00 |
| ATOM | 1544 | CB | ASN | 92 | 9.234 | 10.534 | 5.426 | 1.00 | 0.00 |
| ATOM | 1545 | 2HB | ASN | 92 | 9.660 | 10.324 | 6.407 | 1.00 | 0.00 |
| ATOM | 1546 | QB | ASN | 92 | 9.660 | 10.324 | 6.407 | 1.00 | 0.00 |
| ATOM | 1547 | CG | ASN | 92 | 10.303 | 10.343 | 4.348 | 1.00 | 0.00 |
| ATOM | 1548 | OD1 | ASN | 92 | 10.321 | 11.015 | 3.330 | 1.00 | 0.00 |
| ATOM | 1549 | ND2 | ASN | 92 | 11.190 | 9.393 | 4.628 | 1.00 | 0.00 |
| ATOM | 1550 | 1HD2 | ASN | 92 | 11.118 | 8.878 | 5.482 | 1.00 | 0.00 |
| ATOM | 1551 | 2HD2 | ASN | 92 | 11.929 | 9.193 | 3.984 | 1.00 | 0.00 |
| ATOM | 1552 | QD2 | ASN | 92 | 11.524 | 9.036 | 4.733 | 1.00 | 0.00 |
| ATOM | 1553 | C | ASN | 92 | 8.224 | 8.353 | 6.021 | 1.00 | 0.00 |
| ATOM | 1554 | O | ASN | 92 | 8.761 | 7.357 | 5.542 | 1.00 | 0.00 |
| ATOM | 1555 | N | THR | 93 | 7.772 | 8.438 | 7.264 | 1.00 | 0.00 |
| ATOM | 1556 | H | THR | 93 | 7.336 | 9.253 | 7.646 | 1.00 | 0.00 |
| ATOM | 1557 | CA | THR | 93 | 7.883 | 7.314 | 8.179 | 1.00 | 0.00 |
| ATOM | 1558 | HA | THR | 93 | 8.741 | 6.712 | 7.880 | 1.00 | 0.00 |
| ATOM | 1559 | CB | THR | 93 | 8.115 | 7.872 | 9.585 | 1.00 | 0.00 |
| ATOM | 1560 | HB | THR | 93 | 7.347 | 8.599 | 9.847 | 1.00 | 0.00 |
| ATOM | 1561 | QG2 | THR | 93 | 8.231 | 6.509 | 10.894 | 1.00 | 0.00 |
| ATOM | 1562 | OG1 | THR | 93 | 9.432 | 8.414 | 9.530 | 1.00 | 0.00 |
| ATOM | 1563 | 1HG | THR | 93 | 10.069 | 7.731 | 9.172 | 1.00 | 0.00 |

TABLE 4-continued

Mistic-L Atomic Structure Coordinates

| ATOM | 1564 | CG2 | THR | 93 | 8.209 | 6.771 | 10.643 | 1.00 | 0.00 |
|---|---|---|---|---|---|---|---|---|---|
| ATOM | 1565 | 1HG2 | THR | 93 | 9.252 | 6.624 | 10.923 | 1.00 | 0.00 |
| ATOM | 1566 | 2HG2 | THR | 93 | 7.634 | 7.062 | 11.522 | 1.00 | 0.00 |
| ATOM | 1567 | 3HG2 | THR | 93 | 7.808 | 5.842 | 10.238 | 1.00 | 0.00 |
| ATOM | 1568 | C | THR | 93 | 6.647 | 6.419 | 8.077 | 1.00 | 0.00 |
| ATOM | 1569 | O | THR | 93 | 6.755 | 5.196 | 8.153 | 1.00 | 0.00 |
| ATOM | 1570 | N | ILE | 94 | 5.502 | 7.062 | 7.907 | 1.00 | 0.00 |
| ATOM | 1571 | H | ILE | 94 | 5.422 | 8.057 | 7.845 | 1.00 | 0.00 |
| ATOM | 1572 | CA | ILE | 94 | 4.247 | 6.338 | 7.793 | 1.00 | 0.00 |
| ATOM | 1573 | HA | ILE | 94 | 4.186 | 5.656 | 8.641 | 1.00 | 0.00 |
| ATOM | 1574 | CB | ILE | 94 | 3.062 | 7.300 | 7.900 | 1.00 | 0.00 |
| ATOM | 1575 | HB | ILE | 94 | 3.069 | 7.950 | 7.025 | 1.00 | 0.00 |
| ATOM | 1576 | QG2 | ILE | 94 | 1.420 | 6.359 | 7.883 | 1.00 | 0.00 |
| ATOM | 1577 | CG2 | ILE | 94 | 1.735 | 6.539 | 7.886 | 1.00 | 0.00 |
| ATOM | 1578 | 1HG2 | ILE | 94 | 1.365 | 6.472 | 6.863 | 1.00 | 0.00 |
| ATOM | 1579 | 2HG2 | ILE | 94 | 1.887 | 5.536 | 8.284 | 1.00 | 0.00 |
| ATOM | 1580 | 3HG2 | ILE | 94 | 1.007 | 7.067 | 8.501 | 1.00 | 0.00 |
| ATOM | 1581 | CG1 | ILE | 94 | 3.195 | 8.199 | 9.131 | 1.00 | 0.00 |
| ATOM | 1582 | 2HG1 | ILE | 94 | 2.774 | 9.182 | 8.916 | 1.00 | 0.00 |
| ATOM | 1583 | QG1 | ILE | 94 | 2.774 | 9.182 | 8.916 | 1.00 | 0.00 |
| ATOM | 1584 | QD1 | ILE | 94 | 2.312 | 7.440 | 10.624 | 1.00 | 0.00 |
| ATOM | 1585 | CD1 | ILE | 94 | 2.481 | 7.586 | 10.338 | 1.00 | 0.00 |
| ATOM | 1586 | 1HD1 | ILE | 94 | 1.424 | 7.847 | 10.306 | 1.00 | 0.00 |
| ATOM | 1587 | 2HD1 | ILE | 94 | 2.590 | 6.501 | 10.311 | 1.00 | 0.00 |
| ATOM | 1588 | 3HD1 | ILE | 94 | 2.923 | 7.972 | 11.256 | 1.00 | 0.00 |
| ATOM | 1589 | C | ILE | 94 | 4.254 | 5.513 | 6.505 | 1.00 | 0.00 |
| ATOM | 1590 | O | ILE | 94 | 3.806 | 4.366 | 6.496 | 1.00 | 0.00 |
| ATOM | 1591 | N | ILE | 95 | 4.766 | 6.127 | 5.449 | 1.00 | 0.00 |
| ATOM | 1592 | H | ILE | 95 | 5.129 | 7.058 | 5.465 | 1.00 | 0.00 |
| ATOM | 1593 | CA | ILE | 95 | 4.838 | 5.462 | 4.158 | 1.00 | 0.00 |
| ATOM | 1594 | HA | ILE | 95 | 3.911 | 4.904 | 4.027 | 1.00 | 0.00 |
| ATOM | 1595 | CB | ILE | 95 | 4.910 | 6.491 | 3.029 | 1.00 | 0.00 |
| ATOM | 1596 | HB | ILE | 95 | 3.928 | 6.952 | 2.924 | 1.00 | 0.00 |
| ATOM | 1597 | QG2 | ILE | 95 | 6.135 | 7.873 | 3.448 | 1.00 | 0.00 |
| ATOM | 1598 | CG2 | ILE | 95 | 5.899 | 7.608 | 3.368 | 1.00 | 0.00 |
| ATOM | 1599 | 1HG2 | ILE | 95 | 6.557 | 7.280 | 4.174 | 1.00 | 0.00 |
| ATOM | 1600 | 2HG2 | ILE | 95 | 6.496 | 7.845 | 2.486 | 1.00 | 0.00 |
| ATOM | 1601 | 3HG2 | ILE | 95 | 5.351 | 8.495 | 3.685 | 1.00 | 0.00 |
| ATOM | 1602 | CG1 | ILE | 95 | 5.239 | 5.819 | 1.695 | 1.00 | 0.00 |
| ATOM | 1603 | 2HG1 | ILE | 95 | 5.741 | 4.868 | 1.876 | 1.00 | 0.00 |
| ATOM | 1604 | QG1 | ILE | 95 | 5.741 | 4.868 | 1.876 | 1.00 | 0.00 |
| ATOM | 1605 | QD1 | ILE | 95 | 3.670 | 5.528 | 0.676 | 1.00 | 0.00 |
| ATOM | 1606 | CD1 | ILE | 95 | 3.971 | 5.584 | 0.872 | 1.00 | 0.00 |
| ATOM | 1607 | 1HD1 | ILE | 95 | 3.525 | 6.543 | 0.610 | 1.00 | 0.00 |
| ATOM | 1608 | 2HD1 | ILE | 95 | 4.224 | 5.040 | −0.039 | 1.00 | 0.00 |
| ATOM | 1609 | 3HD1 | ILE | 95 | 3.261 | 5.000 | 1.458 | 1.00 | 0.00 |
| ATOM | 1610 | C | ILE | 95 | 6.004 | 4.471 | 4.164 | 1.00 | 0.00 |
| ATOM | 1611 | O | ILE | 95 | 5.882 | 3.361 | 3.648 | 1.00 | 0.00 |
| ATOM | 1612 | N | LYS+ | 96 | 7.108 | 4.909 | 4.752 | 1.00 | 0.00 |
| ATOM | 1613 | H | LYS+ | 96 | 7.198 | 5.813 | 5.169 | 1.00 | 0.00 |
| ATOM | 1614 | CA | LYS+ | 96 | 8.295 | 4.074 | 4.830 | 1.00 | 0.00 |
| ATOM | 1615 | HA | LYS+ | 96 | 8.530 | 3.744 | 3.818 | 1.00 | 0.00 |
| ATOM | 1616 | CB | LYS+ | 96 | 9.489 | 4.888 | 5.331 | 1.00 | 0.00 |
| ATOM | 1617 | 2HB | LYS+ | 96 | 9.234 | 5.377 | 6.271 | 1.00 | 0.00 |
| ATOM | 1618 | QB | LYS+ | 96 | 9.234 | 5.377 | 6.271 | 1.00 | 0.00 |
| ATOM | 1619 | CG | LYS+ | 96 | 10.715 | 3.995 | 5.531 | 1.00 | 0.00 |
| ATOM | 1620 | 2HG | LYS+ | 96 | 10.966 | 3.499 | 4.593 | 1.00 | 0.00 |
| ATOM | 1621 | QG | LYS+ | 96 | 10.966 | 3.499 | 4.593 | 1.00 | 0.00 |
| ATOM | 1622 | CD | LYS+ | 96 | 11.915 | 4.812 | 6.018 | 1.00 | 0.00 |
| ATOM | 1623 | 2HD | LYS+ | 96 | 11.784 | 5.064 | 7.070 | 1.00 | 0.00 |
| ATOM | 1624 | QD | LYS+ | 96 | 11.784 | 5.064 | 7.070 | 1.00 | 0.00 |
| ATOM | 1625 | CE | LYS+ | 96 | 13.219 | 4.034 | 5.831 | 1.00 | 0.00 |
| ATOM | 1626 | 2HE | LYS+ | 96 | 13.016 | 3.087 | 5.332 | 1.00 | 0.00 |
| ATOM | 1627 | QE | LYS+ | 96 | 13.016 | 3.087 | 5.332 | 1.00 | 0.00 |
| ATOM | 1628 | NZ | LYS+ | 96 | 14.185 | 4.825 | 5.035 | 1.00 | 0.00 |
| ATOM | 1629 | 1HZ | LYS+ | 96 | 14.871 | 5.224 | 5.644 | 1.00 | 0.00 |
| ATOM | 1630 | 2HZ | LYS+ | 96 | 14.635 | 4.229 | 4.371 | 1.00 | 0.00 |
| ATOM | 1631 | 3HZ | LYS+ | 96 | 13.700 | 5.556 | 4.554 | 1.00 | 0.00 |
| ATOM | 1632 | QZ | LYS+ | 96 | 14.402 | 5.003 | 4.857 | 1.00 | 0.00 |
| ATOM | 1633 | C | LYS+ | 96 | 7.990 | 2.841 | 5.684 | 1.00 | 0.00 |
| ATOM | 1634 | O | LYS+ | 96 | 8.608 | 1.792 | 5.508 | 1.00 | 0.00 |
| ATOM | 1635 | N | GLN | 97 | 7.038 | 3.009 | 6.590 | 1.00 | 0.00 |
| ATOM | 1636 | H | GLN | 97 | 6.540 | 3.865 | 6.727 | 1.00 | 0.00 |
| ATOM | 1637 | CA | GLN | 97 | 6.645 | 1.922 | 7.472 | 1.00 | 0.00 |
| ATOM | 1638 | HA | GLN | 97 | 7.558 | 1.362 | 7.667 | 1.00 | 0.00 |
| ATOM | 1639 | CB | GLN | 97 | 6.095 | 2.461 | 8.794 | 1.00 | 0.00 |
| ATOM | 1640 | 2HB | GLN | 97 | 5.503 | 1.689 | 9.287 | 1.00 | 0.00 |
| ATOM | 1641 | QB | GLN | 97 | 5.503 | 1.689 | 9.287 | 1.00 | 0.00 |

TABLE 4-continued

Mistic-L Atomic Structure Coordinates

| ATOM | 1642 | CG | GLN | 97 | 7.228 | 2.910 | 9.717 | 1.00 | 0.00 |
|---|---|---|---|---|---|---|---|---|---|
| ATOM | 1643 | 2HG | GLN | 97 | 6.845 | 3.619 | 10.451 | 1.00 | 0.00 |
| ATOM | 1644 | QG | GLN | 97 | 6.845 | 3.619 | 10.451 | 1.00 | 0.00 |
| ATOM | 1645 | CD | GLN | 97 | 7.858 | 1.715 | 10.435 | 1.00 | 0.00 |
| ATOM | 1646 | OE1 | GLN | 97 | 8.842 | 1.142 | 9.997 | 1.00 | 0.00 |
| ATOM | 1647 | NE2 | GLN | 97 | 7.237 | 1.371 | 11.560 | 1.00 | 0.00 |
| ATOM | 1648 | 1HE2 | GLN | 97 | 6.433 | 1.883 | 11.864 | 1.00 | 0.00 |
| ATOM | 1649 | 2HE2 | GLN | 97 | 7.573 | 0.600 | 12.102 | 1.00 | 0.00 |
| ATOM | 1650 | QE2 | GLN | 97 | 7.003 | 1.242 | 11.983 | 1.00 | 0.00 |
| ATOM | 1651 | C | GLN | 97 | 5.621 | 1.021 | 6.778 | 1.00 | 0.00 |
| ATOM | 1652 | O | GLN | 97 | 5.713 | −0.204 | 6.855 | 1.00 | 0.00 |
| ATOM | 1653 | N | ILE | 98 | 4.668 | 1.661 | 6.116 | 1.00 | 0.00 |
| ATOM | 1654 | H | ILE | 98 | 4.600 | 2.658 | 6.059 | 1.00 | 0.00 |
| ATOM | 1655 | CA | ILE | 98 | 3.628 | 0.933 | 5.410 | 1.00 | 0.00 |
| ATOM | 1656 | HA | ILE | 98 | 3.396 | 0.043 | 5.997 | 1.00 | 0.00 |
| ATOM | 1657 | CB | ILE | 98 | 2.348 | 1.768 | 5.331 | 1.00 | 0.00 |
| ATOM | 1658 | HB | ILE | 98 | 2.612 | 2.813 | 5.488 | 1.00 | 0.00 |
| ATOM | 1659 | QG2 | ILE | 98 | 1.561 | 1.641 | 3.614 | 1.00 | 0.00 |
| ATOM | 1660 | CG2 | ILE | 98 | 1.711 | 1.665 | 3.943 | 1.00 | 0.00 |
| ATOM | 1661 | 1HG2 | ILE | 98 | 0.790 | 2.246 | 3.923 | 1.00 | 0.00 |
| ATOM | 1662 | 2HG2 | ILE | 98 | 2.404 | 2.055 | 3.197 | 1.00 | 0.00 |
| ATOM | 1663 | 3HG2 | ILE | 98 | 1.489 | 0.621 | 3.723 | 1.00 | 0.00 |
| ATOM | 1664 | CG1 | ILE | 98 | 1.370 | 1.377 | 6.441 | 1.00 | 0.00 |
| ATOM | 1665 | 2HG1 | ILE | 98 | 1.122 | 0.319 | 6.357 | 1.00 | 0.00 |
| ATOM | 1666 | QG1 | ILE | 98 | 1.122 | 0.319 | 6.357 | 1.00 | 0.00 |
| ATOM | 1667 | QD1 | ILE | 98 | 2.106 | 1.728 | 8.149 | 1.00 | 0.00 |
| ATOM | 1668 | CD1 | ILE | 98 | 1.964 | 1.661 | 7.821 | 1.00 | 0.00 |
| ATOM | 1669 | 1HD1 | ILE | 98 | 2.241 | 2.713 | 7.889 | 1.00 | 0.00 |
| ATOM | 1670 | 2HD1 | ILE | 98 | 1.226 | 1.429 | 8.590 | 1.00 | 0.00 |
| ATOM | 1671 | 3HD1 | ILE | 98 | 2.850 | 1.042 | 7.969 | 1.00 | 0.00 |
| ATOM | 1672 | C | ILE | 98 | 4.158 | 0.490 | 4.045 | 1.00 | 0.00 |
| ATOM | 1673 | O | ILE | 98 | 3.437 | −0.133 | 3.267 | 1.00 | 0.00 |
| ATOM | 1674 | N | LEU | 99 | 5.415 | 0.828 | 3.797 | 1.00 | 0.00 |
| ATOM | 1675 | H | LEU | 99 | 5.995 | 1.335 | 4.435 | 1.00 | 0.00 |
| ATOM | 1676 | CA | LEU | 99 | 6.051 | 0.473 | 2.539 | 1.00 | 0.00 |
| ATOM | 1677 | HA | LEU | 99 | 5.324 | −0.088 | 1.952 | 1.00 | 0.00 |
| ATOM | 1678 | CB | LEU | 99 | 6.400 | 1.731 | 1.742 | 1.00 | 0.00 |
| ATOM | 1679 | 2HB | LEU | 99 | 7.193 | 2.263 | 2.267 | 1.00 | 0.00 |
| ATOM | 1680 | QB | LEU | 99 | 7.193 | 2.263 | 2.267 | 1.00 | 0.00 |
| ATOM | 1681 | CG | LEU | 99 | 6.848 | 1.507 | 0.296 | 1.00 | 0.00 |
| ATOM | 1682 | HG | LEU | 99 | 7.142 | 0.463 | 0.188 | 1.00 | 0.00 |
| ATOM | 1683 | QD1 | LEU | 99 | 5.422 | 1.813 | −0.911 | 1.00 | 0.00 |
| ATOM | 1684 | QD2 | LEU | 99 | 8.365 | 2.561 | −0.116 | 1.00 | 0.00 |
| ATOM | 1685 | CD1 | LEU | 99 | 5.696 | 1.754 | −0.680 | 1.00 | 0.00 |
| ATOM | 1686 | 1HD1 | LEU | 99 | 5.567 | 0.881 | −1.320 | 1.00 | 0.00 |
| ATOM | 1687 | 2HD1 | LEU | 99 | 4.777 | 1.932 | −0.120 | 1.00 | 0.00 |
| ATOM | 1688 | 3HD1 | LEU | 99 | 5.921 | 2.625 | −1.294 | 1.00 | 0.00 |
| ATOM | 1689 | CD2 | LEU | 99 | 8.074 | 2.358 | −0.038 | 1.00 | 0.00 |
| ATOM | 1690 | 1HD2 | LEU | 99 | 8.689 | 2.475 | 0.855 | 1.00 | 0.00 |
| ATOM | 1691 | 2HD2 | LEU | 99 | 8.656 | 1.869 | −0.818 | 1.00 | 0.00 |
| ATOM | 1692 | 3HD2 | LEU | 99 | 7.751 | 3.339 | −0.387 | 1.00 | 0.00 |
| ATOM | 1693 | QQD | LEU | 99 | 6.893 | 2.187 | −0.514 | 1.00 | 0.00 |
| ATOM | 1694 | C | LEU | 99 | 7.252 | −0.432 | 2.818 | 1.00 | 0.00 |
| ATOM | 1695 | O | LEU | 99 | 7.678 | −1.189 | 1.947 | 1.00 | 0.00 |
| ATOM | 1696 | N | SER | 100 | 7.764 | −0.324 | 4.035 | 1.00 | 0.00 |
| ATOM | 1697 | H | SER | 100 | 7.412 | 0.295 | 4.737 | 1.00 | 0.00 |
| ATOM | 1698 | CA | SER | 100 | 8.909 | −1.122 | 4.439 | 1.00 | 0.00 |
| ATOM | 1699 | HA | SER | 100 | 9.380 | −1.442 | 3.509 | 1.00 | 0.00 |
| ATOM | 1700 | CB | SER | 100 | 9.902 | −0.291 | 5.254 | 1.00 | 0.00 |
| ATOM | 1701 | 2HB | SER | 100 | 9.441 | 0.002 | 6.197 | 1.00 | 0.00 |
| ATOM | 1702 | QB | SER | 100 | 9.441 | 0.002 | 6.197 | 1.00 | 0.00 |
| ATOM | 1703 | OG | SER | 100 | 11.107 | −1.004 | 5.516 | 1.00 | 0.00 |
| ATOM | 1704 | HG | SER | 100 | 11.337 | −0.940 | 6.487 | 1.00 | 0.00 |
| ATOM | 1705 | C | SER | 100 | 8.441 | −2.334 | 5.248 | 1.00 | 0.00 |
| ATOM | 1706 | O | SER | 100 | 9.215 | −3.257 | 5.493 | 1.00 | 0.00 |
| ATOM | 1707 | N | ILE | 101 | 7.177 | −2.290 | 5.642 | 1.00 | 0.00 |
| ATOM | 1708 | H | ILE | 101 | 6.554 | −1.535 | 5.439 | 1.00 | 0.00 |
| ATOM | 1709 | CA | ILE | 101 | 6.597 | −3.372 | 6.420 | 1.00 | 0.00 |
| ATOM | 1710 | HA | ILE | 101 | 7.257 | −3.556 | 7.267 | 1.00 | 0.00 |
| ATOM | 1711 | CB | ILE | 101 | 5.237 | −2.957 | 6.985 | 1.00 | 0.00 |
| ATOM | 1712 | HB | ILE | 101 | 4.879 | −2.098 | 6.417 | 1.00 | 0.00 |
| ATOM | 1713 | QG2 | ILE | 101 | 3.963 | −4.340 | 6.774 | 1.00 | 0.00 |
| ATOM | 1714 | CG2 | ILE | 101 | 4.208 | −4.075 | 6.815 | 1.00 | 0.00 |
| ATOM | 1715 | 1HG2 | ILE | 101 | 4.455 | −4.902 | 7.480 | 1.00 | 0.00 |
| ATOM | 1716 | 2HG2 | ILE | 101 | 3.215 | −3.696 | 7.060 | 1.00 | 0.00 |
| ATOM | 1717 | 3HG2 | ILE | 101 | 4.218 | −4.423 | 5.782 | 1.00 | 0.00 |
| ATOM | 1718 | CG1 | ILE | 101 | 5.364 | −2.513 | 8.445 | 1.00 | 0.00 |
| ATOM | 1719 | 2HG1 | ILE | 101 | 5.288 | −3.380 | 9.101 | 1.00 | 0.00 |

TABLE 4-continued

Mistic-L Atomic Structure Coordinates

| ATOM | 1720 | QG1 | ILE | 101 | 5.288 | −3.380 | 9.101 | 1.00 | 0.00 |
|---|---|---|---|---|---|---|---|---|---|
| ATOM | 1721 | QD1 | ILE | 101 | 7.012 | −1.629 | 8.744 | 1.00 | 0.00 |
| ATOM | 1722 | CD1 | ILE | 101 | 6.696 | −1.798 | 8.686 | 1.00 | 0.00 |
| ATOM | 1723 | 1HD1 | ILE | 101 | 7.136 | −1.515 | 7.730 | 1.00 | 0.00 |
| ATOM | 1724 | 2HD1 | ILE | 101 | 6.524 | −0.904 | 9.286 | 1.00 | 0.00 |
| ATOM | 1725 | 3HD1 | ILE | 101 | 7.376 | −2.466 | 9.216 | 1.00 | 0.00 |
| ATOM | 1726 | C | ILE | 101 | 6.545 | −4.638 | 5.563 | 1.00 | 0.00 |
| ATOM | 1727 | O | ILE | 101 | 6.205 | −5.713 | 6.056 | 1.00 | 0.00 |
| ATOM | 1728 | N | SER | 102 | 6.886 | −4.470 | 4.293 | 1.00 | 0.00 |
| ATOM | 1729 | H | SER | 102 | 7.161 | −3.593 | 3.900 | 1.00 | 0.00 |
| ATOM | 1730 | CA | SER | 102 | 6.884 | −5.587 | 3.362 | 1.00 | 0.00 |
| ATOM | 1731 | HA | SER | 102 | 7.710 | −5.395 | 2.679 | 1.00 | 0.00 |
| ATOM | 1732 | CB | SER | 102 | 7.121 | −6.911 | 4.091 | 1.00 | 0.00 |
| ATOM | 1733 | 2HB | SER | 102 | 7.391 | −7.679 | 3.366 | 1.00 | 0.00 |
| ATOM | 1734 | QB | SER | 102 | 7.391 | −7.679 | 3.366 | 1.00 | 0.00 |
| ATOM | 1735 | OG | SER | 102 | 8.148 | −6.804 | 5.072 | 1.00 | 0.00 |
| ATOM | 1736 | HG | SER | 102 | 7.837 | −7.198 | 5.937 | 1.00 | 0.00 |
| ATOM | 1737 | C | SER | 102 | 5.556 | −5.629 | 2.603 | 1.00 | 0.00 |
| ATOM | 1738 | O | SER | 102 | 5.015 | −6.706 | 2.352 | 1.00 | 0.00 |
| ATOM | 1739 | N | VAL | 103 | 5.070 | −4.447 | 2.257 | 1.00 | 0.00 |
| ATOM | 1740 | H | VAL | 103 | 5.517 | −3.577 | 2.464 | 1.00 | 0.00 |
| ATOM | 1741 | CA | VAL | 103 | 3.817 | −4.336 | 1.529 | 1.00 | 0.00 |
| ATOM | 1742 | HA | VAL | 103 | 3.385 | −5.334 | 1.465 | 1.00 | 0.00 |
| ATOM | 1743 | CB | VAL | 103 | 2.841 | −3.447 | 2.303 | 1.00 | 0.00 |
| ATOM | 1744 | HB | VAL | 103 | 2.088 | −4.092 | 2.757 | 1.00 | 0.00 |
| ATOM | 1745 | QG1 | VAL | 103 | 3.726 | −2.516 | 3.693 | 1.00 | 0.00 |
| ATOM | 1746 | QG2 | VAL | 103 | 1.951 | −2.246 | 1.141 | 1.00 | 0.00 |
| ATOM | 1747 | CG1 | VAL | 103 | 3.556 | −2.695 | 3.425 | 1.00 | 0.00 |
| ATOM | 1748 | 1HG1 | VAL | 103 | 4.001 | −3.411 | 4.117 | 1.00 | 0.00 |
| ATOM | 1749 | 2HG1 | VAL | 103 | 4.339 | −2.065 | 3.001 | 1.00 | 0.00 |
| ATOM | 1750 | 3HG1 | VAL | 103 | 2.839 | −2.072 | 3.960 | 1.00 | 0.00 |
| ATOM | 1751 | CG2 | VAL | 103 | 2.122 | −2.476 | 1.364 | 1.00 | 0.00 |
| ATOM | 1752 | 1HG2 | VAL | 103 | 1.426 | −1.863 | 1.938 | 1.00 | 0.00 |
| ATOM | 1753 | 2HG2 | VAL | 103 | 2.855 | −1.834 | 0.875 | 1.00 | 0.00 |
| ATOM | 1754 | 3HG2 | VAL | 103 | 1.572 | −3.040 | 0.609 | 1.00 | 0.00 |
| ATOM | 1755 | QQG | VAL | 103 | 2.839 | −2.381 | 2.417 | 1.00 | 0.00 |
| ATOM | 1756 | C | VAL | 103 | 4.096 | −3.827 | 0.114 | 1.00 | 0.00 |
| ATOM | 1757 | O | VAL | 103 | 3.389 | −4.180 | −0.827 | 1.00 | 0.00 |
| ATOM | 1758 | N | SER | 104 | 5.130 | −3.005 | 0.008 | 1.00 | 0.00 |
| ATOM | 1759 | H | SER | 104 | 5.701 | −2.722 | 0.779 | 1.00 | 0.00 |
| ATOM | 1760 | CA | SER | 104 | 5.512 | −2.444 | −1.276 | 1.00 | 0.00 |
| ATOM | 1761 | HA | SER | 104 | 4.758 | −1.688 | −1.496 | 1.00 | 0.00 |
| ATOM | 1762 | CB | SER | 104 | 6.890 | −1.783 | −1.202 | 1.00 | 0.00 |
| ATOM | 1763 | 2HB | SER | 104 | 7.654 | −2.506 | −1.487 | 1.00 | 0.00 |
| ATOM | 1764 | QB | SER | 104 | 7.654 | −2.506 | −1.487 | 1.00 | 0.00 |
| ATOM | 1765 | OG | SER | 104 | 6.980 | −0.638 | −2.045 | 1.00 | 0.00 |
| ATOM | 1766 | HG | SER | 104 | 7.685 | −0.017 | −1.704 | 1.00 | 0.00 |
| ATOM | 1767 | C | SER | 104 | 5.505 | −3.536 | −2.347 | 1.00 | 0.00 |
| ATOM | 1768 | O | SER | 104 | 4.876 | −3.382 | −3.393 | 1.00 | 0.00 |
| ATOM | 1769 | N | GLU− | 105 | 6.212 | −4.616 | −2.050 | 1.00 | 0.00 |
| ATOM | 1770 | H | GLU− | 105 | 6.721 | −4.735 | −1.197 | 1.00 | 0.00 |
| ATOM | 1771 | CA | GLU− | 105 | 6.295 | −5.735 | −2.974 | 1.00 | 0.00 |
| ATOM | 1772 | HA | GLU− | 105 | 5.305 | −6.190 | −2.967 | 1.00 | 0.00 |
| ATOM | 1773 | CB | GLU− | 105 | 6.615 | −5.252 | −4.391 | 1.00 | 0.00 |
| ATOM | 1774 | 2HB | GLU− | 105 | 7.595 | −5.622 | −4.693 | 1.00 | 0.00 |
| ATOM | 1775 | QB | GLU− | 105 | 7.595 | −5.622 | −4.693 | 1.00 | 0.00 |
| ATOM | 1776 | CG | GLU− | 105 | 5.555 | −5.731 | −5.385 | 1.00 | 0.00 |
| ATOM | 1777 | 2HG | GLU− | 105 | 4.563 | −5.452 | −5.027 | 1.00 | 0.00 |
| ATOM | 1778 | QG | GLU− | 105 | 4.563 | −5.452 | −5.027 | 1.00 | 0.00 |
| ATOM | 1779 | CD | GLU− | 105 | 5.791 | −5.127 | −6.771 | 1.00 | 0.00 |
| ATOM | 1780 | OE1 | GLU− | 105 | 5.357 | −3.972 | −6.968 | 1.00 | 0.00 |
| ATOM | 1781 | OE2 | GLU− | 105 | 6.400 | −5.835 | −7.601 | 1.00 | 0.00 |
| ATOM | 1782 | C | GLU− | 105 | 7.337 | −6.747 | −2.491 | 1.00 | 0.00 |
| ATOM | 1783 | O | GLU− | 105 | 7.985 | −7.409 | −3.301 | 1.00 | 0.00 |
| ATOM | 1784 | N | GLU− | 106 | 7.464 | −6.833 | −1.175 | 1.00 | 0.00 |
| ATOM | 1785 | H | GLU− | 106 | 6.933 | −6.291 | −0.525 | 1.00 | 0.00 |
| ATOM | 1786 | CA | GLU− | 106 | 8.417 | −7.753 | −0.576 | 1.00 | 0.00 |
| ATOM | 1787 | HA | GLU− | 106 | 8.749 | −7.268 | 0.342 | 1.00 | 0.00 |
| ATOM | 1788 | CB | GLU− | 106 | 7.747 | −9.083 | −0.225 | 1.00 | 0.00 |
| ATOM | 1789 | 2HB | GLU− | 106 | 7.505 | −9.625 | −1.139 | 1.00 | 0.00 |
| ATOM | 1790 | QB | GLU− | 106 | 7.505 | −9.625 | −1.139 | 1.00 | 0.00 |
| ATOM | 1791 | CG | GLU− | 106 | 8.657 | −9.939 | 0.658 | 1.00 | 0.00 |
| ATOM | 1792 | 2HG | GLU− | 106 | 9.700 | −9.762 | 0.391 | 1.00 | 0.00 |
| ATOM | 1793 | QG | GLU− | 106 | 9.700 | −9.762 | 0.391 | 1.00 | 0.00 |
| ATOM | 1794 | CD | GLU− | 106 | 8.443 | −9.622 | 2.139 | 1.00 | 0.00 |
| ATOM | 1795 | OE1 | GLU− | 106 | 9.177 | −8.745 | 2.644 | 1.00 | 0.00 |
| ATOM | 1796 | OE2 | GLU− | 106 | 7.549 | −10.262 | 2.733 | 1.00 | 0.00 |
| ATOM | 1797 | C | GLU− | 106 | 9.607 | −7.969 | −1.511 | 1.00 | 0.00 |

TABLE 4-continued

Mistic-L Atomic Structure Coordinates

| ATOM | 1798 | O | GLU− | 106 | 10.097 | −9.089 | −1.650 | 1.00 | 0.00 |
| ATOM | 1799 | N | GLY | 107 | 10.040 | −6.879 | −2.129 | 1.00 | 0.00 |
| ATOM | 1800 | H | GLY | 107 | 9.637 | −5.972 | −2.009 | 1.00 | 0.00 |
| ATOM | 1801 | CA | GLY | 107 | 11.165 | −6.936 | −3.047 | 1.00 | 0.00 |
| ATOM | 1802 | 1HA | GLY | 107 | 11.323 | −7.963 | −3.371 | 1.00 | 0.00 |
| ATOM | 1803 | 2HA | GLY | 107 | 10.941 | −6.350 | −3.938 | 1.00 | 0.00 |
| ATOM | 1804 | QA | GLY | 107 | 11.132 | −7.157 | −3.655 | 1.00 | 0.00 |
| ATOM | 1805 | C | GLY | 107 | 12.438 | −6.402 | −2.387 | 1.00 | 0.00 |
| ATOM | 1806 | O | GLY | 107 | 13.094 | −5.512 | −2.924 | 1.00 | 0.00 |
| ATOM | 1807 | N | GLU− | 108 | 12.751 | −6.971 | −1.231 | 1.00 | 0.00 |
| ATOM | 1808 | H | GLU− | 108 | 12.212 | −7.696 | −0.801 | 1.00 | 0.00 |
| ATOM | 1809 | CA | GLU− | 108 | 13.935 | −6.565 | −0.493 | 1.00 | 0.00 |
| ATOM | 1810 | HA | GLU− | 108 | 13.967 | −7.215 | 0.382 | 1.00 | 0.00 |
| ATOM | 1811 | CB | GLU− | 108 | 15.200 | −6.779 | −1.325 | 1.00 | 0.00 |
| ATOM | 1812 | 2HB | GLU− | 108 | 15.710 | −5.827 | −1.469 | 1.00 | 0.00 |
| ATOM | 1813 | QB | GLU− | 108 | 15.710 | −5.827 | −1.469 | 1.00 | 0.00 |
| ATOM | 1814 | CG | GLU− | 108 | 16.144 | −7.771 | −0.642 | 1.00 | 0.00 |
| ATOM | 1815 | 2HG | GLU− | 108 | 15.921 | −8.782 | −0.980 | 1.00 | 0.00 |
| ATOM | 1816 | QG | GLU− | 108 | 15.921 | −8.782 | −0.980 | 1.00 | 0.00 |
| ATOM | 1817 | CD | GLU− | 108 | 17.606 | −7.437 | −0.946 | 1.00 | 0.00 |
| ATOM | 1818 | OE1 | GLU− | 108 | 18.056 | −7.814 | −2.050 | 1.00 | 0.00 |
| ATOM | 1819 | OE2 | GLU− | 108 | 18.239 | −6.811 | −0.069 | 1.00 | 0.00 |
| ATOM | 1820 | C | GLU− | 108 | 13.809 | −5.106 | −0.051 | 1.00 | 0.00 |
| ATOM | 1821 | O | GLU− | 108 | 14.799 | −4.377 | −0.016 | 1.00 | 0.00 |
| ATOM | 1822 | N | LYS+ | 109 | 12.583 | −4.723 | 0.275 | 1.00 | 0.00 |
| ATOM | 1823 | H | LYS+ | 109 | 11.783 | −5.322 | 0.244 | 1.00 | 0.00 |
| ATOM | 1824 | CA | LYS+ | 109 | 12.316 | −3.364 | 0.714 | 1.00 | 0.00 |
| ATOM | 1825 | HA | LYS+ | 109 | 11.447 | −3.398 | 1.372 | 1.00 | 0.00 |
| ATOM | 1826 | CB | LYS+ | 109 | 13.487 | −2.826 | 1.537 | 1.00 | 0.00 |
| ATOM | 1827 | 2HB | LYS+ | 109 | 14.228 | −2.379 | 0.874 | 1.00 | 0.00 |
| ATOM | 1828 | QB | LYS+ | 109 | 14.228 | −2.379 | 0.874 | 1.00 | 0.00 |
| ATOM | 1829 | CG | LYS+ | 109 | 13.012 | −1.786 | 2.553 | 1.00 | 0.00 |
| ATOM | 1830 | 2HG | LYS+ | 109 | 11.991 | −2.013 | 2.862 | 1.00 | 0.00 |
| ATOM | 1831 | QG | LYS+ | 109 | 11.991 | −2.013 | 2.862 | 1.00 | 0.00 |
| ATOM | 1832 | CD | LYS+ | 109 | 13.926 | −1.758 | 3.779 | 1.00 | 0.00 |
| ATOM | 1833 | 2HD | LYS+ | 109 | 14.389 | −2.735 | 3.914 | 1.00 | 0.00 |
| ATOM | 1834 | QD | LYS+ | 109 | 14.389 | −2.735 | 3.914 | 1.00 | 0.00 |
| ATOM | 1835 | CE | LYS+ | 109 | 15.012 | −0.690 | 3.629 | 1.00 | 0.00 |
| ATOM | 1836 | 2HE | LYS+ | 109 | 14.904 | −0.186 | 2.669 | 1.00 | 0.00 |
| ATOM | 1837 | QE | LYS+ | 109 | 14.904 | −0.186 | 2.669 | 1.00 | 0.00 |
| ATOM | 1838 | NZ | LYS+ | 109 | 14.924 | 0.297 | 4.727 | 1.00 | 0.00 |
| ATOM | 1839 | 1HZ | LYS+ | 109 | 15.235 | 1.190 | 4.399 | 1.00 | 0.00 |
| ATOM | 1840 | 2HZ | LYS+ | 109 | 13.975 | 0.369 | 5.037 | 1.00 | 0.00 |
| ATOM | 1841 | 3HZ | LYS+ | 109 | 15.502 | 0.002 | 5.489 | 1.00 | 0.00 |
| ATOM | 1842 | QZ | LYS+ | 109 | 14.904 | 0.520 | 4.975 | 1.00 | 0.00 |
| ATOM | 1843 | C | LYS+ | 109 | 11.969 | −2.500 | −0.500 | 1.00 | 0.00 |
| ATOM | 1844 | O | LYS+ | 109 | 11.079 | −1.653 | −0.431 | 1.00 | 0.00 |
| ATOM | 1845 | N | GLU− | 110 | 12.691 | −2.743 | −1.585 | 1.00 | 0.00 |
| ATOM | 1846 | H | GLU− | 110 | 13.412 | −3.434 | −1.633 | 1.00 | 0.00 |
| ATOM | 1847 | CA | GLU− | 110 | 12.471 | −1.998 | −2.813 | 1.00 | 0.00 |
| ATOM | 1848 | HA | GLU− | 110 | 11.563 | −2.416 | −3.247 | 1.00 | 0.00 |
| ATOM | 1849 | CB | GLU− | 110 | 12.248 | −0.512 | −2.520 | 1.00 | 0.00 |
| ATOM | 1850 | 2HB | GLU− | 110 | 12.944 | 0.086 | −3.107 | 1.00 | 0.00 |
| ATOM | 1851 | QB | GLU− | 110 | 12.944 | 0.086 | −3.107 | 1.00 | 0.00 |
| ATOM | 1852 | CG | GLU− | 110 | 10.811 | −0.100 | −2.847 | 1.00 | 0.00 |
| ATOM | 1853 | 2HG | GLU− | 110 | 10.166 | −0.306 | −1.993 | 1.00 | 0.00 |
| ATOM | 1854 | QG | GLU− | 110 | 10.166 | −0.306 | −1.993 | 1.00 | 0.00 |
| ATOM | 1855 | CD | GLU− | 110 | 10.736 | 1.387 | −3.203 | 1.00 | 0.00 |
| ATOM | 1856 | OE1 | GLU− | 110 | 11.163 | 2.197 | −2.351 | 1.00 | 0.00 |
| ATOM | 1857 | OE2 | GLU− | 110 | 10.253 | 1.680 | −4.318 | 1.00 | 0.00 |
| ATOM | 1858 | C | GLU− | 110 | 13.646 | −2.197 | −3.772 | 1.00 | 0.00 |
| ATOM | 1859 | O | GLU− | 110 | 14.492 | −1.317 | −3.914 | 1.00 | 0.00 |
| ATOM | 1860 | N | LEU | 111 | 13.660 | −3.361 | −4.405 | 1.00 | 0.00 |
| ATOM | 1861 | H | LEU | 111 | 12.968 | −4.072 | −4.284 | 1.00 | 0.00 |
| ATOM | 1862 | CA | LEU | 111 | 14.718 | −3.687 | −5.347 | 1.00 | 0.00 |
| ATOM | 1863 | HA | LEU | 111 | 14.534 | −4.700 | −5.706 | 1.00 | 0.00 |
| ATOM | 1864 | CB | LEU | 111 | 14.658 | −2.759 | −6.562 | 1.00 | 0.00 |
| ATOM | 1865 | 2HB | LEU | 111 | 15.655 | −2.357 | −6.737 | 1.00 | 0.00 |
| ATOM | 1866 | QB | LEU | 111 | 15.655 | −2.357 | −6.737 | 1.00 | 0.00 |
| ATOM | 1867 | CG | LEU | 111 | 14.157 | −3.390 | −7.864 | 1.00 | 0.00 |
| ATOM | 1868 | HG | LEU | 111 | 14.217 | −4.474 | −7.764 | 1.00 | 0.00 |
| ATOM | 1869 | QD1 | LEU | 111 | 12.340 | −2.956 | −8.172 | 1.00 | 0.00 |
| ATOM | 1870 | QD2 | LEU | 111 | 15.260 | −2.901 | −9.323 | 1.00 | 0.00 |
| ATOM | 1871 | CD1 | LEU | 111 | 12.689 | −3.040 | −8.113 | 1.00 | 0.00 |
| ATOM | 1872 | 1HD1 | LEU | 111 | 12.624 | −2.274 | −8.886 | 1.00 | 0.00 |
| ATOM | 1873 | 2HD1 | LEU | 111 | 12.153 | −3.931 | −8.439 | 1.00 | 0.00 |
| ATOM | 1874 | 3HD1 | LEU | 111 | 12.243 | −2.665 | −7.192 | 1.00 | 0.00 |
| ATOM | 1875 | CD2 | LEU | 111 | 15.048 | −2.995 | −9.043 | 1.00 | 0.00 |

TABLE 4-continued

Mistic-L Atomic Structure Coordinates

| ATOM | 1876 | 1HD2 | LEU | 111 | 14.985 | −1.918 | −9.201 | 1.00 | 0.00 |
| --- | --- | --- | --- | --- | --- | --- | --- | --- | --- |
| ATOM | 1877 | 2HD2 | LEU | 111 | 16.081 | −3.270 | −8.826 | 1.00 | 0.00 |
| ATOM | 1878 | 3HD2 | LEU | 111 | 14.715 | −3.514 | −9.941 | 1.00 | 0.00 |
| ATOM | 1879 | QQD | LEU | 111 | 13.800 | −2.929 | −8.748 | 1.00 | 0.00 |
| ATOM | 1880 | C | LEU | 111 | 16.064 | −3.666 | −4.623 | 1.00 | 0.00 |
| ATOM | 1881 | O | LEU | 111 | 16.538 | −4.700 | −4.155 | 1.00 | 0.00 |
| ATOM | 1882 | N | VAL | 112 | 16.643 | −2.476 | −4.552 | 1.00 | 0.00 |
| ATOM | 1883 | H | VAL | 112 | 16.251 | −1.639 | −4.935 | 1.00 | 0.00 |
| ATOM | 1884 | CA | VAL | 112 | 17.927 | −2.306 | −3.892 | 1.00 | 0.00 |
| ATOM | 1885 | HA | VAL | 112 | 18.228 | −3.280 | −3.504 | 1.00 | 0.00 |
| ATOM | 1886 | CB | VAL | 112 | 18.980 | −1.853 | −4.906 | 1.00 | 0.00 |
| ATOM | 1887 | HB | VAL | 112 | 18.556 | −1.032 | −5.485 | 1.00 | 0.00 |
| ATOM | 1888 | QG1 | VAL | 112 | 20.530 | −1.208 | −4.030 | 1.00 | 0.00 |
| ATOM | 1889 | QG2 | VAL | 112 | 19.412 | −3.251 | −6.107 | 1.00 | 0.00 |
| ATOM | 1890 | CG1 | VAL | 112 | 20.232 | −1.332 | −4.198 | 1.00 | 0.00 |
| ATOM | 1891 | 1HG1 | VAL | 112 | 20.119 | −1.454 | −3.121 | 1.00 | 0.00 |
| ATOM | 1892 | 2HG1 | VAL | 112 | 21.102 | −1.894 | −4.537 | 1.00 | 0.00 |
| ATOM | 1893 | 3HG1 | VAL | 112 | 20.369 | −0.276 | −4.431 | 1.00 | 0.00 |
| ATOM | 1894 | CG2 | VAL | 112 | 19.329 | −2.983 | −5.876 | 1.00 | 0.00 |
| ATOM | 1895 | 1HG2 | VAL | 112 | 20.278 | −2.762 | −6.365 | 1.00 | 0.00 |
| ATOM | 1896 | 2HG2 | VAL | 112 | 19.413 | −3.920 | −5.327 | 1.00 | 0.00 |
| ATOM | 1897 | 3HG2 | VAL | 112 | 18.545 | −3.070 | −6.629 | 1.00 | 0.00 |
| ATOM | 1898 | QQG | VAL | 112 | 19.971 | −2.229 | −5.068 | 1.00 | 0.00 |
| ATOM | 1899 | C | VAL | 112 | 17.768 | −1.336 | −2.720 | 1.00 | 0.00 |
| ATOM | 1900 | O | VAL | 112 | 17.167 | −0.273 | −2.867 | 1.00 | 0.00 |
| ATOM | 1901 | N | PRO | 113 | 18.333 | −1.747 | −1.553 | 1.00 | 0.00 |
| ATOM | 1902 | CD | PRO | 113 | 19.053 | −3.001 | −1.343 | 1.00 | 0.00 |
| ATOM | 1903 | CA | PRO | 113 | 18.260 | −0.927 | −0.356 | 1.00 | 0.00 |
| ATOM | 1904 | HA | PRO | 113 | 17.347 | −0.530 | −0.262 | 1.00 | 0.00 |
| ATOM | 1905 | CB | PRO | 113 | 18.584 | −1.872 | 0.789 | 1.00 | 0.00 |
| ATOM | 1906 | 2HB | PRO | 113 | 17.679 | −2.177 | 1.312 | 1.00 | 0.00 |
| ATOM | 1907 | QB | PRO | 113 | 17.679 | −2.177 | 1.312 | 1.00 | 0.00 |
| ATOM | 1908 | CG | PRO | 113 | 19.279 | −3.068 | 0.158 | 1.00 | 0.00 |
| ATOM | 1909 | 2HG | PRO | 113 | 18.880 | −3.998 | 0.564 | 1.00 | 0.00 |
| ATOM | 1910 | QG | PRO | 113 | 18.880 | −3.998 | 0.564 | 1.00 | 0.00 |
| ATOM | 1911 | 2HD | PRO | 113 | 18.474 | −3.854 | −1.695 | 1.00 | 0.00 |
| ATOM | 1912 | QD | PRO | 113 | 18.474 | −3.854 | −1.695 | 1.00 | 0.00 |
| ATOM | 1913 | C | PRO | 113 | 19.223 | 0.259 | −0.445 | 1.00 | 0.00 |
| ATOM | 1914 | O | PRO | 113 | 18.821 | 1.405 | −0.255 | 1.00 | 0.00 |
| ATOM | 1915 | N | ARG+ | 114 | 20.477 | −0.059 | −0.734 | 1.00 | 0.00 |
| ATOM | 1916 | H | ARG+ | 114 | 20.795 | −0.994 | −0.887 | 1.00 | 0.00 |
| ATOM | 1917 | CA | ARG+ | 114 | 21.501 | 0.966 | −0.850 | 1.00 | 0.00 |
| ATOM | 1918 | HA | ARG+ | 114 | 21.073 | 1.843 | −0.365 | 1.00 | 0.00 |
| ATOM | 1919 | CB | ARG+ | 114 | 22.788 | 0.541 | −0.139 | 1.00 | 0.00 |
| ATOM | 1920 | 2HB | ARG+ | 114 | 23.386 | −0.081 | −0.806 | 1.00 | 0.00 |
| ATOM | 1921 | QB | ARG+ | 114 | 23.386 | −0.081 | −0.806 | 1.00 | 0.00 |
| ATOM | 1922 | CG | ARG+ | 114 | 23.601 | 1.761 | 0.297 | 1.00 | 0.00 |
| ATOM | 1923 | 2HG | ARG+ | 114 | 22.941 | 2.496 | 0.759 | 1.00 | 0.00 |
| ATOM | 1924 | QG | ARG+ | 114 | 22.941 | 2.496 | 0.759 | 1.00 | 0.00 |
| ATOM | 1925 | CD | ARG+ | 114 | 24.700 | 1.362 | 1.284 | 1.00 | 0.00 |
| ATOM | 1926 | 2HD | ARG+ | 114 | 24.344 | 0.564 | 1.935 | 1.00 | 0.00 |
| ATOM | 1927 | QD | ARG+ | 114 | 24.344 | 0.564 | 1.935 | 1.00 | 0.00 |
| ATOM | 1928 | NE | ARG+ | 114 | 25.904 | 0.915 | 0.549 | 1.00 | 0.00 |
| ATOM | 1929 | HE | ARG+ | 114 | 26.619 | 1.589 | 0.365 | 1.00 | 0.00 |
| ATOM | 1930 | CZ | ARG+ | 114 | 26.095 | −0.338 | 0.112 | 1.00 | 0.00 |
| ATOM | 1931 | NH1 | ARG+ | 114 | 27.217 | −0.654 | −0.548 | 1.00 | 0.00 |
| ATOM | 1932 | 1HH1 | ARG+ | 114 | 27.359 | −1.588 | −0.873 | 1.00 | 0.00 |
| ATOM | 1933 | 2HH1 | ARG+ | 114 | 27.913 | 0.045 | −0.713 | 1.00 | 0.00 |
| ATOM | 1934 | QH1 | ARG+ | 114 | 27.636 | −0.771 | −0.793 | 1.00 | 0.00 |
| ATOM | 1935 | NH2 | ARG+ | 114 | 25.162 | −1.274 | 0.335 | 1.00 | 0.00 |
| ATOM | 1936 | 1HH2 | ARG+ | 114 | 25.305 | −2.209 | 0.009 | 1.00 | 0.00 |
| ATOM | 1937 | 2HH2 | ARG+ | 114 | 24.324 | −1.038 | 0.826 | 1.00 | 0.00 |
| ATOM | 1938 | QH2 | ARG+ | 114 | 24.815 | −1.623 | 0.417 | 1.00 | 0.00 |
| ATOM | 1939 | C | ARG+ | 114 | 21.807 | 1.245 | −2.323 | 1.00 | 0.00 |
| ATOM | 1940 | O | ARG+ | 114 | 22.177 | 0.338 | −3.066 | 1.00 | 0.00 |

SEQUENCE LISTING (221 sequences)

SEQ ID NO: 1 - DNA, 333 bp, Bacillus subtilis
atgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggagaaaaagaatga

SEQ ID NO: 2 - protein, 110 aa, Bacillus subtilis
MFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKE

SEQ ID NO: 3 - DNA, 390 bp, Artificial Sequence
  MISTIC fusion protein / protein domain pMistic
  misc_feature (1)..(60): octa-his sequence
  misc_feature (61)..(390): Mistic sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaa

SEQ ID NO: 4 - protein, 130 aa, Artificial Sequence
  MISTIC fusion protein / protein domain pMistic
  MISC_FEATURE (1)..(20): octa-his sequence
  MISC_FEATURE (21)..(130): Mistic sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKE

SEQ ID NO: 5 - DNA, 390 bp, Artificial Sequence
  MISTIC fusion protein / protein domain pMistic(W13A)
  misc_feature (1)..(60): octa-his sequence
  misc_feature (61)..(390): Mistic mutant sequence
atgaaacaccaccaccaccaccaccaccacggtggtctggttccgcgtggttcccatggcatgttttgtacattttttgaaaaacatcaccggaaggcggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaa

SEQ ID NO: 6 - protein, 130 aa, Artificial Sequence
  MISTIC fusion protein / protein domain pMistic(W13A)
  MISC_FEATURE (1)..(20): octa-his sequence
  MISC_FEATURE (21)..(130): Mistic mutant sequence
MKHHHHHHHHGGLVPRGSHGMFCTFFEKHHRKADILLEKSTGVMEAMKVTSEEKEQLSTAIDRMNEGLDAFIQLYNESEIDEPLIQLDDDTAELMKQARDMYGQEKLNEKLNTIIKQILSISVSEEGEKE

SEQ ID NO: 7 - DNA, 390 bp, Artificial Sequence
  MISTIC fusion protein / protein domain pMistic(Q36E)
  misc_feature (1)..(60): octa-his sequence
  misc_feature (61)..(390): Mistic mutant sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaagagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaa

SEQ ID NO: 8 - protein, 130 aa, Artificial Sequence
  MISTIC fusion protein / protein domain pMistic(Q36E)
  MISC_FEATURE (1)..(20): octa-his sequence
  MISC_FEATURE (21)..(130): Mistic mutant sequence
MKHHHHHHHHGGLVPRGSHGMFCTFFEKHHRKWDILLEKSTGVMEAMKVTSEEKEELSTAIDRMNEGLDAFIQLYNESEIDEPLIQLDDDTAELMKQARDMYGQEKLNEKLNTIIKQILSISVSEEGEKE

SEQ ID NO: 9 - DNA, 390 bp, Artificial Sequence
  MISTIC fusion protein / protein domain pMistic(M75A)
  misc_feature (1)..(60): octa-his sequence
  misc_feature (61)..(390): Mistic mutant sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttagcgaagcaggcccgagatatgtacggccaggaaaagctaaatgagaaattaaatacaattattaaacagattttatccatctcagtatctgaagaaggcgaaaaagaa

SEQ ID NO: 10 - protein, 130 aa, Artificial Sequence
  MISTIC fusion protein / protein domain pMistic(M75A)
  MISC_FEATURE (1)..(20): octa-his sequence
  MISC_FEATURE (21)..(130): Mistic mutant sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELAKQARDMYGQEKLNEKLNTIIKQILSISVSEEGEKE

SEQ ID NO: 11 - DNA, 390 bp, Artificial Sequence
  MISTIC fusion protein / protein domain pMistic(C3V)
  misc_feature (1)..(60): octa-his sequence
  misc_feature (61)..(390): Mistic mutant sequence
atgaaacaccaccaccaccaccaccaccacggtggtctggttccgcgtggttcccatggcatgtttgtaacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaa

SEQ ID NO: 12 - protein, 130 aa, Artificial Sequence
  MISTIC fusion protein / protein domain pMistic(C3V)
  MISC_FEATURE (1)..(20): octa-his sequence
  MISC_FEATURE (21)..(130): Mistic mutant sequence
MKHHHHHHHHGGLVPRGSHGMFVTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKE

SEQ ID NO: 13 - DNA, 390 bp, Artificial Sequence
  MISTIC fusion protein / protein domain pMistic(C3L)
  misc_feature (1)..(60): octa-his sequence
  misc_feature (61)..(390): Mistic mutant sequence
atgaaacaccaccaccaccaccaccaccacggtggtctggttccgcgtggttcccatggcatgtttctaacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaa

SEQ ID NO: 14 - protein, 130 aa, Artificial Sequence
  MISTIC fusion protein / protein domain pMistic(C3L)
  MISC_FEATURE (1)..(20): octa-his sequence
  MISC_FEATURE (21)..(130): Mistic mutant sequence
MKHHHHHHHHGGLVPRGSHGMFLTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKE

SEQ ID NO: 15 - DNA, 390 bp, Artificial Sequence
  MISTIC fusion protein / protein domain pMistic(C3I)
  misc_feature (1)..(60): octa-his sequence
  misc_feature (61)..(390): Mistic mutant sequence
atgaaacaccaccaccaccaccaccaccacggtggtctggttccgcgtggttcccatggcatgtttataacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaa

SEQ ID NO: 16 - protein, 130 aa, Artificial Sequence
  MISTIC fusion protein / protein domain pMistic(C3I)
  MISC_FEATURE (1)..(20): octa-his sequence
  MISC_FEATURE (21)..(130): Mistic mutant sequence
MKHHHHHHHHGGLVPRGSHGMFITFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKE

SEQ ID NO: 17 - DNA, 390 bp, Artificial Sequence
  MISTIC fusion protein / protein domain pMistic(C3S)
  misc_feature (1)..(60): octa-his sequence
  misc_feature (61)..(390): Mistic mutant sequence
atgaaacaccaccaccaccaccaccaccacggtggtctggttccgcgtggttcccatggcatgttttctacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaa

SEQ ID NO: 18 - protein, 130 aa, Artificial Sequence
  MISTIC fusion protein / protein domain pMistic(C3S)
  MISC_FEATURE (1)..(20): octa-his sequence
  MISC_FEATURE (21)..(130): Mistic mutant sequence
MKHHHHHHHHGGLVPRGSHGMFSTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKE

SEQ ID NO: 19 - DNA, 390 bp, Artificial Sequence
  MISTIC fusion protein / protein domain pMistic(C3V/T30C)
  misc_feature (1)..(60): octa-his sequence
  misc_feature (61)..(390): Mistic mutant sequence
atgaaacaccaccaccaccaccaccaccacggtggtctggttccgcgtggttcccatggcatgtttgtaacattttttgaaaaacatcaccggaagtgggacatactgttagaaaaaagcacgggtgtgatggaagctatgaaagtgtgtagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaa

SEQ ID NO: 20 - protein, 130 aa, Artificial Sequence
  MISTIC fusion protein / protein domain pMistic(C3V/T30C)
  MISC_FEATURE (1)..(20): octa-his sequence
  MISC_FEATURE (21)..(130): Mistic mutant sequence
MKHHHHHHHHGGLVPRGSHGMFVTFFEKHHRKWDILLEKSTGVMEAMKVCSEEKEQLSTAIDRMNEGLDAFIQLYNESEIDEPLIQLDDDTAELMKQARDMYGQEKLNEKLNTIIKQILSISVSEEGEKE

SEQ ID NO: 21 - DNA, 390 bp, Artificial Sequence
  MISTIC fusion protein / protein domain pMistic(C3V/S58C)
  misc_feature (1)..(60): octa-his sequence
  misc_feature (61)..(390): Mistic mutant sequence
atgaaacaccaccaccaccaccaccaccacggtggtctggttccgcgtggttcccatggcatgtttgtaacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatgtgaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaa

SEQ ID NO: 22 - protein, 130 aa, Artificial Sequence
  MISTIC fusion protein / protein domain pMistic(C3V/S58C)
  MISC_FEATURE (1)..(20): octa-his sequence
  MISC_FEATURE (21)..(130): Mistic mutant sequence
MKHHHHHHHHGGLVPRGSHGMFVTFFEKHHRKWDILLEKSTGVMEAMKVTSEEKEQLSTAIDRMNEGLDAFIQLYNECEIDEPLIQLDDDTAELMKQARDMYGQEKLNEKLNTIIKQILSISVSEEGEKE

SEQ ID NO: 23 - DNA, 390 bp, Artificial Sequence
  MISTIC fusion protein / protein domain pMistic(C3V/N88C)
  misc_feature (1)..(60): octa-his sequence
  misc_feature (61)..(390): Mistic mutant sequence
atgaaacaccaccaccaccaccaccaccacggtggtctggttccgcgtggttcccatggcatgtttgtaacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctatgtgagaaattaaatacaattattaaacagattttatccatctcagtatctgaagaaggcgaaaaagaa

SEQ ID NO: 24 - protein, 130 aa, Artificial Sequence
  MISTIC fusion protein / protein domain pMistic(C3V/N88C)
  MISC_FEATURE (1)..(20): octa-his sequence
  MISC_FEATURE (21)..(130): Mistic mutant sequence
MKHHHHHHHHGGLVPRGSHGMFVTFFEKHHRKWDILLEKSTGVMEAMKVTSEEKEQLSTAIDRMNEGLDAFIQLYNESEIDEPLIQLDDDTAELMKQARDMYGQEKLCEKLNTIIKQILSISVSEEGEKE

SEQ ID NO: 25 - DNA, 390 bp, Artificial Sequence
  MISTIC fusion protein / protein domain pMistic(C3V/E110C)
  misc_feature (1)..(60): octa-his sequence
  misc_feature (61)..(390): Mistic mutant sequence
atgaaacaccaccaccaccaccaccaccacggtggtctggttccgcgtggttcccatggcatgtttgtaacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaatgt

SEQ ID NO: 26 - protein, 130 aa, Artificial Sequence
  MISTIC fusion protein / protein domain pMistic(C3V/E110C)
  MISC_FEATURE (1)..(20): octa-his sequence
  MISC_FEATURE (21)..(130): Mistic mutant sequence
MKHHHHHHHHGGLVPRGSHGMFVTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKC

SEQ ID NO: 27 - DNA, 390 bp, Artificial Sequence
  MISTIC fusion protein / protein domain pMistic(EK)
  misc_feature (1)..(60): octa-his sequence
  misc_feature (61)..(390): Mistic mutant sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaa

SEQ ID NO: 28 - protein, 130 aa, Artificial Sequence
  MISTIC fusion protein / protein domain pMistic(EK)
  MISC_FEATURE (1)..(20): octa-his sequence
  MISC_FEATURE (21)..(130): Mistic mutant sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSDDDDKE

SEQ ID NO: 29 - DNA, 390 bp, Artificial Sequence
  MISTIC fusion protein / protein domain pMistic(EK/C3S)
  misc_feature (1)..(60): octa-his sequence
  misc_feature (61)..(390): Mistic mutant sequence
atgaaacaccaccaccaccaccaccaccacggtggtctggttccgcgtggttcccatggcatgttttctacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaa

SEQ ID NO: 30 - protein, 130 aa, Artificial Sequence
  MISTIC fusion protein / protein domain pMistic(EK/C3S)
  MISC_FEATURE (1)..(20): octa-his sequence
  MISC_FEATURE (21)..(130): Mistic mutant sequence
MKHHHHHHHHGGLVPRGSHGMFSTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSDDDDKE

SEQ ID NO: 31 - DNA, 390 bp, Artificial Sequence
  MISTIC fusion protein / protein domain pMistic(EK/W13A)
  misc_feature (1)..(60): octa-his sequence
  misc_feature (61)..(390): Mistic mutant sequence
atgaaacaccaccaccaccaccaccaccacggtggtctggttccgcgtggttcccatggcatgttttgtacattttttgaaaaacatcaccggaaggcggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaa

SEQ ID NO: 32 - protein, 130 aa, Artificial Sequence
  MISTIC fusion protein / protein domain pMistic(EK/W13A)
  MISC_FEATURE (1)..(20): octa-his sequence
  MISC_FEATURE (21)..(130): Mistic mutant sequence
MKHHHHHHHHGGLVPRGSHGMFCTFFEKHHRKADILLEKSTGVMEAMKVTSEEKEQLSTAIDRMNEGLDAFIQLYNESEIDEPLIQLDDDTAELMKQARDMYGQEKLNEKLNTIIKQILSISVSDDDDKE

SEQ ID NO: 33 - DNA, 390 bp, Artificial Sequence
  MISTIC fusion protein / protein domain pMistic(EK/Q36E)
  misc_feature (1)..(60): octa-his sequence
  misc_feature (61)..(390): Mistic mutant sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaagagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaa

SEQ ID NO: 34 - protein, 130 aa, Artificial Sequence
  MISTIC fusion protein / protein domain pMistic(EK/Q36E)
  MISC_FEATURE (1)..(20): octa-his sequence
  MISC_FEATURE (21)..(130): Mistic mutant sequence
MKHHHHHHHHGGLVPRGSHGMFCTFFEKHHRKWDILLEKSTGVMEAMKVTSEEKEELSTAIDRMNEGLDAFIQLYNESEIDEPLIQLDDDTAELMKQARDMYGQEKLNEKLNTIIKQILSISVSDDDDKE

SEQ ID NO: 35 - DNA, 390 bp, Artificial Sequence
  MISTIC fusion protein / protein domain pMistic(EK/M75A)
  misc_feature (1)..(60): octa-his sequence
  misc_feature (61)..(390): Mistic mutant sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttagcgaagcaggcccgagatatgtacggccaggaaaagctaaatgagaaattaaatacaattattaaacagattttatccatctcagtatctgacgacgacgacaaagaa

SEQ ID NO: 36 - protein, 130 aa, Artificial Sequence
  MISTIC fusion protein / protein domain pMistic(EK/M75A)
  MISC_FEATURE (1)..(20): octa-his sequence
  MISC_FEATURE (21)..(130): Mistic mutant sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELAKQARDMYGQEKLNEKLNTIIKQILSISVSDDDDKE

SEQ ID NO: 37 - DNA, 18 bp, Artificial Sequence
  thrombin (Thr) sequence
ctagttccgcggggatca

SEQ ID NO: 38 - protein, 6 aa, Artificial Sequence
  thrombin (Thr) sequence
LVPRGS

SEQ ID NO: 39 - DNA, 36 bp, Artificial Sequence
  Link sequence
atgaaccatggcatgcccctagttccgcggggatca

SEQ ID NO: 40 - protein, 12 aa, Artificial Sequence
  Link sequence
MNHGMPLVPRGS

SEQ ID NO: 41 - DNA, 33 bp, Artificial Sequence
  L sequence
ggctcctctggcagcagcggttcctcactagtc

SEQ ID NO: 42 - protein, 11 aa, Artificial Sequence
  L sequence
GSSGSSGSSLV

SEQ ID NO: 43 - DNA, 27 bp, Artificial Sequence
  LI sequence
ggctcctctggcagcagcggttcctca

SEQ ID NO: 44 - protein, 9 aa, Artificial Sequence
  LI sequence
GSSGSSGSS

SEQ ID NO: 45 - DNA, 66 bp, Artificial Sequence
  LINKER sequence
ggctcctctggcagcagcggttcctcactagttccgcggggatcatccggtagctctggcagctcc

SEQ ID NO: 46 - protein, 22 aa, Artificial Sequence
  LINKER sequence
GSSGSSGSSLVPRGSSGSSGSS

SEQ ID NO: 47 - DNA, 45 bp, Artificial Sequence
  LINK sequence
ggctcctctggcagcagcggttcctcactagttccgcgtgtttcc

SEQ ID NO: 48 - protein, 15 aa, Artificial Sequence
  LINK sequence
GSSGSSGSSLVPRGS

SEQ ID NO: 49 - DNA, 57 bp, Artificial Sequence
  LINK2 sequence
ggctcctctggcagcagcggttcctcactagttccgcgtgtttccggctcgagcggt

SEQ ID NO: 50 - protein, 19 aa, Artificial Sequence
  LINK2 sequence
GSSGSSGSSLVPRGSGSSG

SEQ ID NO: 51 - DNA, 1185 bp, Artificial Sequence
  MISTIC fusion protein / protein domain pMistic-KchBsu265
  misc_feature (1)..(60): octa-his sequence
  misc_feature (61)..(390): Mistic sequence
  misc_feature (391)..(1185): KchBsu265 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaatgaaatcaaatcggatatttatttcatggctcaggtggccgttatttatccgaatcggggttattattttatgtctgattcttttgttcggccaaatcatttatatacttgagcctaagcagttcacttcggtattcgaaggtatttggtgggctgtcgttacggtttctacagtcggttatggagactatgtgccgcacactccgctgggacaggcagccggaatactgctgattttgagcggagcaagctttgtcacagcgtatttcgctacgttatcagcggccgcattcagcagacagcatcgctacattgaaggaaaagttgcttacaaaggccgggaccacatcattctgatcgggtggaatgaaaaaacaaaccggcttttgaaggaccttcagcttgccgccccttccaaaacagtcgtactaatcgatgaatccttaacagaaggcccgcttattgaaaacgttcatttcatacgcgggcacgctgccgatgatgggacactgaaacgggccaatattactgaagcggaatcagtgatgattactgccgatcagtataaaagtgaaactgatgctgatatgctgtcagtgctgactcttttatctgttaaaggtcttaatccccttgcttactgcatcgtcgagattttaactgaccgttttgtcaccaatgcggaacgggcaggcgcaaaccaaatcatcggaacttcagaatttatcagccgggcgatgctgcagcattaccaagtcaagttacggcgtctaaacagcagaacggaatcaagc

SEQ ID NO: 52 - protein, 395 aa, Artificial Sequence
  MISTIC fusion protein / protein domain pMistic-KchBsu265
  MISC_FEATURE (1)..(20): octa-his sequence
  MISC_FEATURE (21)..(130): Mistic sequence
  MISC_FEATURE (131)..(395): KchBsu265 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKEMKSNRIFISWLRWPLFIRIGVIILCLILLFGQIIYILEPKQFTSVFEGIWWAVVTVSTVGYGDYVPHTPLGQAAGILLILSGASFVTAYFATLSAAAFSRQHRYIEGKVAYKGRDHIILIGWNEKTNRLLKDLQLAAPSKTVVLIDESLTEGPLIENVHFIRGHAADDGTLKRANITEAESVMITADQYKSETDADMLSVLTLLSVKGLNPLAYCIVEILTDRFVTNAERAGANQIIGTSEFISRAMLQHYQVKLRRLNSRTESS

SEQ ID NO: 53 - DNA, 1185 bp, Artificial Sequence
  MISTIC fusion protein / protein domain pMistic(EK)-KchBsu265
  misc_feature (1)..(60): octa-his sequence
  misc_feature (61)..(390): Mistic mutant sequence
  misc_feature (391)..(1185): KchBsu265 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaaatgaaatcaaatcggatatttatttcatggctcaggtggccgttatttatccgaatcggggttattattttatgtctgattcttttgttcggccaaatcatttatatacttgagcctaagcagttcacttcggtattcgaaggtatttggtgggctgtcgttacggtttctacagtcggttatggagactatgtgccgcacactccgctgggacaggcagccggaatactgctgattttgagcggagcaagctttgtcacagcgtatttcgctacgttatcagcggccgcattcagcagacagcatcgctacattgaaggaaaagttgcttacaaaggccgggaccacatcattctgatcgggtggaatgaaaaaacaaaccggcttttgaaggaccttcagcttgccgccccttccaaaacagtcgtactaatcgatgaatccttaacagaaggcccgcttattgaaaacgttcatttcatacgcgggcacgctgccgatgatgggacactgaaacgggccaatattactgaagcggaatcagtgatgattactgccgatcagtataaaagtgaaactgatgctgatatgctgtcagtgctgactcttttatctgttaaaggtcttaatccccttgcttactgcatcgtcgagattttaactgaccgttttgtcaccaatgcggaacgggcaggcgcaaaccaaatcatcggaacttcagaatttatcagccgggcgatgctgcagcattaccaagtcaagttacggcgtctaaacagcagaacggaatcaagc

SEQ ID NO: 54 - protein, 395 aa, Artificial Sequence
  MISTIC fusion protein / protein domain pMistic(EK)-KchBsu265
  MISC_FEATURE (1)..(20): octa-his sequence
  MISC_FEATURE (21)..(130): Mistic mutant sequence
  MISC_FEATURE (131)..(395): KchBsu265 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSDDDDKEMKSNRIFISWLRWPLFIRIGVIILCLILLFGQIIYILEPKQFTSVFEGIWWAVVTVSTVGYGDYVPHTPLGQAAGILLILSGASFVTAYFATLSAAAFSRQHRYIEGKVAYKGRDHIILIGWNEKTNRLLKDLQLAAPSKTVVLIDESLTEGPLIENVHFIRGHAADDGTLKRANITEAESVMITADQYKSETDADMLSVLTLLSVKGLNPLAYCIVEILTDRFVTNAERAGANQIIGTSEFISRAMLQHYQVKLRRLNSRTESS

SEQ ID NO: 55 - DNA, 1290 bp, Artificial Sequence
  MISTIC fusion protein / protein domain pMistic(EK)-KchXfa297
  misc_feature (1)..(60): octa-his sequence
  misc_feature (1)..(60): octa-his sequence
  misc_feature (61)..(390): Mistic mutant sequence
  misc_feature (391)..(1290): KchXfa297 sequence
  misc_feature (609)..(609): n= any nucleotide
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaaatgaaccatggcatgcccctacttttcgactcacaaatgacgccaatcaccaacagcggttggcgccgccactggttcgagatcgtctaccgtcacgacacacccccatcacggaactttgatctgctactgatgttagcgatcttgggcagcgtccttgtggtcatgctcgacagcgttctagccctccaagcacactggaaagacttcctgtacggnctggaatggctctttaccctcatattcaccgccgactacctgatccgcttggtagtggtgcaacagcgcctacgttacgtactgagtatttggggaatcatcgacctcctatcgatcctacccacctacctatccctcttcatgcccggcacacagagcctgctgatcgtccgcgtcctgcgactcctgcgactattccgcatccttaaaatgacccactatgtcgaagaaagcggcgaactagtgcaggccctatggcgcagccgacgcaaagtcatgctattcatctgcaccgtcatgaccatcgccatgattgccggtgccaccatgtatgtcatcgaaggcccccaacacggcttcaccagcattcccaccggcatgtactgggccatcgtgaccatgaccaccgtcggattcggtgacattacacctcaaagcacactgggccgctttgtcacctcagcactcatcctgattggatacagcatcatcgccgttcctaccggcatctacaccgccgaactgacccaaggcctactccgcagcgaagaagaacaccgtcacgacatgcgaacctgcccacattgcggcctccaaggacatgaccacgacgcacgctattgccgcaactgcggcggaatactgccggaaaccctgcatgaacctaatccagctacacag

SEQ ID NO: 56 - protein, 430 aa, Artificial Sequence
  MISTIC fusion protein / protein domain pMistic(EK)-KchXfa297
  MISC_FEATURE (1)..(20): octa-his sequence
  MISC_FEATURE (21)..(130): Mistic mutant sequence
  MISC_FEATURE (131)..(430): KchXfa297 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSDDDDKEMNHGMPLLFDSQMTPITNSGWRRHWFEIVYRHDTPPSRNFDLLLMLAILGSVLVVMLDSVLALQAHWKDFLYGLEWLFTLIFTADYLIRLVVVQQRLRYVLSIWGIIDLLSILPTYLSLFMPGTQSLLIVRVLRLLRLFRILKMTHYVEESGELVQALWRSRRKVMLFICTVMTIAMIAGATMYVIEGPQHGFTSIPTGMYWAIVTMTTVGFGDITPQSTLGRFVTSALILIGYSIIAVPTGIYTAELTQGLLRSEEEHRHDMRTCPHCGLQGHDHDARYCRNCGGILPETLHEPNPATQ

SEQ ID NO: 57 - DNA, 1053 bp, Artificial Sequence
  MISTIC fusion protein / protein domain pMistic(EK)-Link-KchMja209
  misc_feature (1)..(60): octa-his sequence
  misc_feature (61)..(390): Mistic mutant sequence
  misc_feature (391)..(426): Link sequence
  misc_feature (427)..(1053): KchMja209 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaaatgaaccatggcatgcccctagttccgcggggatcaatgaacttaaaagataggcggttaaagaaaataatggaagtattgagtttaatttttacatttgagatagtcgcttctttcattctctcaacatataatccaccgtatcaagacttactaataaagttagattatatctctattatgttctttacatttgagtttatatacaatttttattatgttgaagacaaggcaaagttttttaaagacatttacaatattgttgatgccatagttgttattgctttcttactgtattctttacaggtattttattcaaaggcattcttaggacttagggttataaacctactaagaattttagttttacttagaataattaagttaagaaagttagaagaaaatcaggcattaataaactttctaacattattaacaatttgctttattgcttcctgcttaatatggattgtcgaatcaggtgtaaatccagcaataaacgatttctttgatgctttttatttcacaacaatatcaataacaacggttggttatggagatataacaccaaaaacagatgctgggaagctaataataatattctcagtcctattctttatatctggtttaataacctctttacaaaaggcattaaagggagat

SEQ ID NO: 58 - protein, 351 aa, Artificial Sequence
  MISTIC fusion protein / protein domain pMistic(EK)-Link-KchMja209
  MISC_FEATURE (1)..(20): octa-his sequence
  MISC_FEATURE (21)..(130): Mistic mutant sequence
  MISC_FEATURE (131)..(142): Link sequence
  MISC_FEATURE (143)..(351): KchMja209 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSDDDDKEMNHGMPLVPRGSMNLKDRRLKKIMEVLSLIFTFEIVASFILSTYNPPYQDLLIKLDYISIMFFTFEFIYNFYYVEDKAKFFKDIYNIVDAIVVIAFLLYSLQVFYSKAFLGLRVINLLRILVLLRIIKLRKLEENQALINFLTLLTICFIASCLIWIVESGVNPAINDFFDAFYFTTISITTVGYGDITPKTDAGKLIIIFSVLFFISGLITSLQKALKGD

SEQ ID NO: 59 - DNA, 1278 bp, Artificial Sequence
  MISTIC fusion protein / protein domain pMistic(EK)-Link-KchPae283
  misc_feature (1)..(60): octa-his sequence
  misc_feature (61)..(390): Mistic mutant sequence
  misc_feature (391)..(426): Link sequence
  misc_feature (427)..(1278): KchPae283 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaaatgaaccatggcatgcccctagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaatccaccaggactacggcgacctgctggcctacatcgaatggggcttcaccggcatcttcctggtggaatacctgctgcgcctgtactgctcgcccaagccgctgcgctatgccttcagcttctacggcctggtcgacctgctggcgatcctccccggcttcctygccctgctctaccccgacgcccagtacctgctgatcgtccgggtgatacgcatgctgcggatcttccgcgtgctcaagctacgccagtacctgagccaggccaatttcctgctcaccgccctgcgcggcagcaagcagaagatcatcgtgttcttcctcaccgtgatgaccctggtcaccgtgttcggcgcgctgatgtacgtggtcgaaggcccggagcacggtttcaccagcatcccgcgcggcatctactgggcgatcgtcaccctgaccacggtcggcttcggcgacatcaccccgaagaccccgctcggccaggccatcgccagcctggtgatgctcaccggctactcgatcatcgcggtgcccaccgggatcttcaccgccgaactcgccaccgcgatgcgccaggacccggccaacctgttgcagcgggattgcccggtgtgccgcaaggcgacccacgaagtgcaggcggcattctgctgccgctgcggcaacccgttgttccctcgcgaggaagacagccatgggaagtcttga

SEQ ID NO: 60 - protein, 425 aa, Artificial Sequence
  MISTIC fusion protein / protein domain pMistic(EK)-Link-KchPae283
  MISC_FEATURE (1)..(20): octa-his sequence
  MISC_FEATURE (21)..(130): Mistic mutant sequence
  MISC_FEATURE (131)..(142): Link sequence
  MISC_FEATURE (143)..(425): KchPae283 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSDDDDKEMNHGMPLVPRGSMSAPDSWRERLYIVIFQTDTRDGRRFDSALLLVILASLLVVMIDSIDEIHQDYGDLLAYIEWGFTGIFLVEYLLRLYCSPKPLRYAFSFYGLVDLLAILPGFLALLYPDAQYLLIVRVIRMLRIFRVLKLRQYLSQANFLLTALRGSKQKIIVFFLTVMTLVTVFGALMYVVEGPEHGFTSIPRGIYWAIVTLTTVGFGDITPKTPLGQAIASLVMLTGYSIIAVPTGIFTAELATAMRQDPANLLQRDCPVCRKATHEVQAAFCCRCGNPLFPREEDSHGKS

SEQ ID NO: 61 - DNA, 1278 bp, Artificial Sequence
  MISTIC fusion protein / protein domain pMistic-Link-KchPae283
  misc_feature (1)..(60): octa-his sequence
  misc_feature (61)..(390): Mistic sequence
  misc_feature (391)..(426): Link sequence
  misc_feature (427)..(1278): KchPae283 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaatgaaccatggcatgcccctagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaatccaccaggactacggcgacctgctggcctacatcgaatggggcttcaccggcatcttcctggtggaatacctgctgcgcctgtactgctcgcccaagccgctgcgctatgccttcagcttctacggcctggtcgacctgctggcgatcctccccggcttcctygccctgctctaccccgacgcccagtacctgctgatcgtccgggtgatacgcatgctgcggatcttccgcgtgctcaagctacgccagtacctgagccaggccaatttcctgctcaccgccctgcgcggcagcaagcagaagatcatcgtgttcttcctcaccgtgatgaccctggtcaccgtgttcggcgcgctgatgtacgtggtcgaaggcccggagcacggtttcaccagcatcccgcgcggcatctactgggcgatcgtcaccctgaccacggtcggcttcggcgacatcaccccgaagaccccgctcggccaggccatcgccagcctggtgatgctcaccggctactcgatcatcgcggtgcccaccgggatcttcaccgccgaactcgccaccgcgatgcgccaggacccggccaacctgttgcagcgggattgcccggtgtgccgcaaggcgacccacgaagtgcaggcggcattctgctgccgctgcggcaacccgttgttccctcgcgaggaagacagccatgggaagtcttga

SEQ ID NO: 62 - protein, 425 aa, Artificial Sequence
  MISTIC fusion protein / protein domain pMistic-Link-KchPae283
  MISC_FEATURE (1)..(20): octa-his sequence
  MISC_FEATURE (21)..(130): Mistic sequence
  MISC_FEATURE (131)..(142): Link sequence
  MISC_FEATURE (143)..(425): KchPae283 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKEMNHGMPLVPRGSMSAPDSWRERLYIVIFQTDTRDGRRFDSALLLVILASLLVVMIDSIDEIHQDYGDLLAYIEWGFTGIFLVEYLLRLYCSPKPLRYAFSFYGLVDLLAILPGFLALLYPDAQYLLIVRVIRMLRIFRVLKLRQYLSQANFLLTALRGSKQKIIVFFLTVMTLVTVFGALMYVVEGPEHGFTSIPRGIYWAIVTLTTVGFGDITPKTPLGQAIASLVMLTGYSIIAVPTGIFTAELATAMRQDPANLLQRDCPVCRKATHEVQAAFCCRCGNPLFPREEDSHGKS

SEQ ID NO: 63 - DNA, 1260 bp, Artificial Sequence
  MISTIC fusion protein / protein domain pMistic-Thr-KchPae283
  misc_feature (1)..(60): octa-his sequence
  misc_feature (61)..(390): Mistic sequence
  misc_feature (391)..(408): Thr sequence
  misc_feature (409)..(1260): KchPae283 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaatccaccaggactacggcgacctgctggcctacatcgaatggggcttcaccggcatcttcctggtggaatacctgctgcgcctgtactgctcgcccaagccgctgcgctatgccttcagcttctacggcctggtcgacctgctggcgatcctccccggcttcctygccctgctctaccccgacgcccagtacctgctgatcgtccgggtgatacgcatgctgcggatcttccgcgtgctcaagctacgccagtacctgagccaggccaatttcctgctcaccgccctgcgcggcagcaagcagaagatcatcgtgttcttcctcaccgtgatgaccctggtcaccgtgttcggcgcgctgatgtacgtggtcgaaggcccggagcacggtttcaccagcatcccgcgcggcatctactgggcgatcgtcaccctgaccacggtcggcttcggcgacatcaccccgaagaccccgctcggccaggccatcgccagcctggtgatgctcaccggctactcgatcatcgcggtgcccaccgggatcttcaccgccgaactcgccaccgcgatgcgccaggacccggccaacctgttgcagcgggattgcccggtgtgccgcaaggcgacccacgaagtgcaggcggcattctgctgccgctgcggcaacccgttgttccctcgcgaggaagacagccatgggaagtcttga

SEQ ID NO: 64 - protein, 419 aa, Artificial Sequence
  MISTIC fusion protein / protein domain pMistic-Thr-KchPae283
  MISC_FEATURE (1)..(20): octa-his sequence
  MISC_FEATURE (21)..(130): Mistic sequence
  MISC_FEATURE (131)..(136): Thr sequence
  MISC_FEATURE (137)..(419): KchPae283 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKELVPRGSMSAPDSWRERLYIVIFQTDTRDGRRFDSALLLVILASLLVVMIDSIDEIHQDYGDLLAYIEWGFTGIFLVEYLLRLYCSPKPLRYAFSFYGLVDLLAILPGFLALLYPDAQYLLIVRVIRMLRIFRVLKLRQYLSQANFLLTALRGSKQKIIVFFLTVMTLVTVFGALMYVVEGPEHGFTSIPRGIYWAIVTLTTVGFGDITPKTPLGQAIASLVMLTGYSIIAVPTGIFTAELATAMRQDPANLLQRDCPVCRKATHEVQAAFCCRCGNPLFPREEDSHGKS

SEQ ID NO: 65 - DNA, 1278 bp, Artificial Sequence
  MISTIC fusion protein / protein domain pMistic(EK/C3S)-Link-KchPae283
  misc_feature (1)..(60): octa-his sequence
  misc_feature (61)..(390): Mistic mutant sequence
  misc_feature (391)..(426): Link sequence
  misc_feature (427)..(1278): KchPae283 sequence
atgaaacaccaccaccaccaccaccaccacggtggtctggttccgcgtggttcccatggcatgttttctacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaaatgaaccatggcatgcccctagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaatccaccaggactacggcgacctgctggcctacatcgaatggggcttcaccggcatcttcctggtggaatacctgctgcgcctgtactgctcgcccaagccgctgcgctatgccttcagcttctacggcctggtcgacctgctggcgatcctccccggcttcctygccctgctctaccccgacgcccagtacctgctgatcgtccgggtgatacgcatgctgcggatcttccgcgtgctcaagctacgccagtacctgagccaggccaatttcctgctcaccgccctgcgcggcagcaagcagaagatcatcgtgttcttcctcaccgtgatgaccctggtcaccgtgttcggcgcgctgatgtacgtggtcgaaggcccggagcacggtttcaccagcatcccgcgcggcatctactgggcgatcgtcaccctgaccacggtcggcttcggcgacatcaccccgaagaccccgctcggccaggccatcgccagcctggtgatgctcaccggctactcgatcatcgcggtgcccaccgggatcttcaccgccgaactcgccaccgcgatgcgccaggacccggccaacctgttgcagcgggattgcccggtgtgccgcaaggcgacccacgaagtgcaggcggcattctgctgccgctgcggcaacccgttgttccctcgcgaggaagacagccatgggaagtcttga

SEQ ID NO: 66 - protein, 425 aa, Artificial Sequence
  MISTIC fusion protein / protein domain pMistic(EK/C3S)-Link-KchPae283
  MISC_FEATURE (1)..(20): octa-his sequence
  MISC_FEATURE (21)..(130): Mistic mutant sequence
  MISC_FEATURE (131)..(412): Link sequence
  MISC_FEATURE (413)..(425): KchPae283 sequence
MKHHHHHHHHGGLVPRGSHGMFSTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSDDDDKEMNHGMPLVPRGSMSAPDSWRERLYIVIFQTDTRDGRRFDSALLLVILASLLVVMIDSIDEIHQDYGDLLAYIEWGFTGIFLVEYLLRLYCSPKPLRYAFSFYGLVDLLAILPGFLALLYPDAQYLLIVRVIRMLRIFRVLKLRQYLSQANFLLTALRGSKQKIIVFFLTVMTLVTVFGALMYVVEGPEHGFTSIPRGIYWAIVTLTTVGFGDITPKTPLGQAIASLVMLTGYSIIAVPTGIFTAELATAMRQDPANLLQRDCPVCRKATHEVQAAFCCRCGNPLFPREEDSHGKS

SEQ ID NO: 67 - DNA, 1260 bp, Artificial Sequence
  MISTIC fusion protein / protein domain pMistic(C3V)-Thr-KchPae283
  misc_feature (1)..(60): octa-his sequence
  misc_feature (61)..(390): Mistic mutant sequence
  misc_feature (391)..(408): Thr sequence
  misc_feature (409)..(1260): KchPae283 sequence
atgaaacaccaccaccaccaccaccaccacggtggtctggttccgcgtggttcccatggcatgtttgtaacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaatccaccaggactacggcgacctgctggcctacatcgaatggggcttcaccggcatcttcctggtggaatacctgctgcgcctgtactgctcgcccaagccgctgcgctatgccttcagcttctacggcctggtcgacctgctggcgatcctccccggcttcctygccctgctctaccccgacgcccagtacctgctgatcgtccgggtgatacgcatgctgcggatcttccgcgtgctcaagctacgccagtacctgagccaggccaatttcctgctcaccgccctgcgcggcagcaagcagaagatcatcgtgttcttcctcaccgtgatgaccctggtcaccgtgttcggcgcgctgatgtacgtggtcgaaggcccggagcacggtttcaccagcatcccgcgcggcatctactgggcgatcgtcaccctgaccacggtcggcttcggcgacatcaccccgaagaccccgctcggccaggccatcgccagcctggtgatgctcaccggctactcgatcatcgcggtgcccaccgggatcttcaccgccgaactcgccaccgcgatgcgccaggacccggccaacctgttgcagcgggattgcccggtgtgccgcaaggcgacccacgaagtgcaggcggcattctgctgccgctgcggcaacccgttgttccctcgcgaggaagacagccatgggaagtcttga

SEQ ID NO: 68 - protein, 419 aa, Artificial Sequence
  MISTIC fusion protein / protein domain pMistic(C3V)-Thr-KchPae283
  MISC_FEATURE (1)..(20): octa-his sequence
  MISC_FEATURE (21)..(130): Mistic mutant sequence
  MISC_FEATURE (131)..(136): Thr sequence
  MISC_FEATURE (137)..(419): KchPae283 sequence
MKHHHHHHHHGGLVPRGSHGMFVTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKELVPRGSMSAPDSWRERLYIVIFQTDTRDGRRFDSALLLVILASLLVVMIDSIDEIHQDYGDLLAYIEWGFTGIFLVEYLLRLYCSPKPLRYAFSFYGLVDLLAILPGFLALLYPDAQYLLIVRVIRMLRIFRVLKLRQYLSQANFLLTALRGSKQKIIVFFLTVMTLVTVFGALMYVVEGPEHGFTSIPRGIYWAIVTLTTVGFGDITPKTPLGQAIASLVMLTGYSIIAVPTGIFTAELATAMRQDPANLLQRDCPVCRKATHEVQAAFCCRCGNPLFPREEDSHGKS

SEQ ID NO: 69 - DNA, 1260 bp, Artificial Sequence
  MISTIC fusion protein / protein domain pMistic(C3I)-Thr-KchPae283
  misc_feature (1)..(60): octa-his sequence
  misc_feature (61)..(390): Mistic mutant sequence
  misc_feature (391)..(408): Thr sequence
  misc_feature (409)..(1260): KchPae283 sequence
atgaaacaccaccaccaccaccaccaccacggtggtctggttccgcgtggttcccatggcatgtttataacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaatccaccaggactacggcgacctgctggcctacatcgaatggggcttcaccggcatcttcctggtggaatacctgctgcgcctgtactgctcgcccaagccgctgcgctatgccttcagcttctacggcctggtcgacctgctggcgatcctccccggcttcctygccctgctctaccccgacgcccagtacctgctgatcgtccgggtgatacgcatgctgcggatcttccgcgtgctcaagctacgccagtacctgagccaggccaatttcctgctcaccgccctgcgcggcagcaagcagaagatcatcgtgttcttcctcaccgtgatgaccctggtcaccgtgttcggcgcgctgatgtacgtggtcgaaggcccggagcacggtttcaccagcatcccgcgcggcatctactgggcgatcgtcaccctgaccacggtcggcttcggcgacatcaccccgaagaccccgctcggccaggccatcgccagcctggtgatgctcaccggctactcgatcatcgcggtgcccaccgggatcttcaccgccgaactcgccaccgcgatgcgccaggacccggccaacctgttgcagcgggattgcccggtgtgccgcaaggcgacccacgaagtgcaggcggcattctgctgccgctgcggcaacccgttgttccctcgcgaggaagacagccatgggaagtcttga

SEQ ID NO: 70 - protein, 419 aa, Artificial Sequence
  MISTIC fusion protein / protein domain pMistic(C3I)-Thr-KchPae283
  MISC_FEATURE (1)..(20): octa-his sequence
  MISC_FEATURE (21)..(130): Mistic mutant sequence
  MISC_FEATURE (131)..(136): Thr sequence
  MISC_FEATURE (137)..(419): KchPae283 sequence
MKHHHHHHHHGGLVPRGSHGMFITFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKELVPRGSMSAPDSWRERLYIVIFQTDTRDGRRFDSALLLVILASLLVVMIDSIDEIHQDYGDLLAYIEWGFTGIFLVEYLLRLYCSPKPLRYAFSFYGLVDLLAILPGFLALLYPDAQYLLIVRVIRMLRIFRVLKLRQYLSQANFLLTALRGSKQKIIVFFLTVMTLVTVFGALMYVVEGPEHGFTSIPRGIYWAIVTLTTVGFGDITPKTPLGQAIASLVMLTGYSIIAVPTGIFTAELATAMRQDPANLLQRDCPVCRKATHEVQAAFCCRCGNPLFPREEDSHGKS

SEQ ID NO: 71 - DNA, 1260 bp, Artificial Sequence
  MISTIC fusion protein / protein domain pMistic(C3L)-Thr-KchPae283
  misc_feature (1)..(60): octa-his sequence
  misc_feature (61)..(390): Mistic mutant sequence
  misc_feature (391)..(408): Thr sequence
  misc_feature (409)..(1260): KchPae283 sequence
atgaaacaccaccaccaccaccaccaccacggtggtctggttccgcgtggttcccatggcatgtttctaacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaatccaccaggactacggcgacctgctggcctacatcgaatggggcttcaccggcatcttcctggtggaatacctgctgcgcctgtactgctcgcccaagccgctgcgctatgccttcagcttctacggcctggtcgacctgctggcgatcctccccggcttcctygccctgctctaccccgacgcccagtacctgctgatcgtccgggtgatacgcatgctgcggatcttccgcgtgctcaagctacgccagtacctgagccaggccaatttcctgctcaccgccctgcgcggcagcaagcagaagatcatcgtgttcttcctcaccgtgatgaccctggtcaccgtgttcggcgcgctgatgtacgtggtcgaaggcccggagcacggtttcaccagcatcccgcgcggcatctactgggcgatcgtcaccctgaccacggtcggcttcggcgacatcaccccgaagaccccgctcggccaggccatcgccagcctggtgatgctcaccggctactcgatcatcgcggtgcccaccgggatcttcaccgccgaactcgccaccgcgatgcgccaggacccggccaacctgttgcagcgggattgcccggtgtgccgcaaggcgacccacgaagtgcaggcggcattctgctgccgctgcggcaacccgttgttccctcgcgaggaagacagccatgggaagtcttga

SEQ ID NO: 72 - protein, 419 aa, Artificial Sequence
  MISTIC fusion protein / protein domain pMistic(C3L)-Thr-KchPae283
  MISC_FEATURE (1)..(20): octa-his sequence
  MISC_FEATURE (21)..(130): Mistic mutant sequence
  MISC_FEATURE (131)..(136): Thr sequence
  MISC_FEATURE (137)..(419): KchPae283 sequence
MKHHHHHHHHGGLVPRGSHGMFLTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKELVPRGSMSAPDSWRERLYIVIFQTDTRDGRRFDSALLLVILASLLVVMIDSIDEIHQDYGDLLAYIEWGFTGIFLVEYLLRLYCSPKPLRYAFSFYGLVDLLAILPGFLALLYPDAQYLLIVRVIRMLRIFRVLKLRQYLSQANFLLTALRGSKQKIIVFFLTVMTLVTVFGALMYVVEGPEHGFTSIPRGIYWAIVTLTTVGFGDITPKTPLGQAIASLVMLTGYSIIAVPTGIFTAELATAMRQDPANLLQRDCPVCRKATHEVQAAFCCRCGNPLFPREEDSHGKS

SEQ ID NO: 73 - DNA, 1260 bp, Artificial Sequence
  MISTIC fusion protein / protein domain pMistic(C3V/T30C)-Thr-KchPae283
  misc_feature (1)..(60): octa-his sequence
  misc_feature (61)..(390): Mistic mutant sequence
  misc_feature (391)..(408): Thr sequence
  misc_feature (409)..(1260): KchPae283 sequence
atgaaacaccaccaccaccaccaccaccacggtggtctggttccgcgtggttcccatggcatgtttgtaacattttttgaaaaacatcaccggaagtgggacatactgttagaaaaaagcacgggtgtgatggaagctatgaaagtgtgtagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaatccaccaggactacggcgacctgctggcctacatcgaatggggcttcaccggcatcttcctggtggaatacctgctgcgcctgtactgctcgcccaagccgctgcgctatgccttcagcttctacggcctggtcgacctgctggcgatcctccccggcttcctygccctgctctaccccgacgcccagtacctgctgatcgtccgggtgatacgcatgctgcggatcttccgcgtgctcaagctacgccagtacctgagccaggccaatttcctgctcaccgccctgcgcggcagcaagcagaagatcatcgtgttcttcctcaccgtgatgaccctggtcaccgtgttcggcgcgctgatgtacgtggtcgaaggcccggagcacggtttcaccagcatcccgcgcggcatctactgggcgatcgtcaccctgaccacggtcggcttcggcgacatcaccccgaagaccccgctcggccaggccatcgccagcctggtgatgctcaccggctactcgatcatcgcggtgcccaccgggatcttcaccgccgaactcgccaccgcgatgcgccaggacccggccaacctgttgcagcgggattgcccggtgtgccgcaaggcgacccacgaagtgcaggcggcattctgctgccgctgcggcaacccgttgttccctcgcgaggaagacagccatgggaagtcttga

SEQ ID NO: 74 - protein, 419 aa, Artificial Sequence
  MISTIC fusion protein / protein domain pMistic(C3V/T30C)-Thr-KchPae283
  MISC_FEATURE (1)..(20): octa-his sequence
  MISC_FEATURE (21)..(130): Mistic mutant sequence
  MISC_FEATURE (131)..(136): Thr sequence
  MISC_FEATURE (137)..(419): KchPae283 sequence
MKHHHHHHHHGGLVPRGSHGMFVTFFEKHHRKWDILLEKSTGVMEAMKVCSEEKEQLSTAIDRMNEGLDAFIQLYNESEIDEPLIQLDDDTAELMKQARDMYGQEKLNEKLNTIIKQILSISVSEEGEKELVPRGSMSAPDSWRERLYIVIFQTDTRDGRRFDSALLLVILASLLVVMIDSIDEIHQDYGDLLAYIEWGFTGIFLVEYLLRLYCSPKPLRYAFSFYGLVDLLAILPGFLALLYPDAQYLLIVRVIRMLRIFRVLKLRQYLSQANFLLTALRGSKQKIIVFFLTVMTLVTVFGALMYVVEGPEHGFTSIPRGIYWAIVTLTTVGFGDITPKTPLGQAIASLVMLTGYSIIAVPTGIFTAELATAMRQDPANLLQRDCPVCRKATHEVQAAFCCRCGNPLFPREEDSHGKS

SEQ ID NO: 75 - DNA, 1260 bp, Artificial Sequence
  MISTIC fusion protein / protein domain pMistic(C3V/S58C)-Thr-KchPae283
  misc_feature (1)..(60): octa-his sequence
  misc_feature (61)..(390): Mistic mutant sequence
  misc_feature (391)..(408): Thr sequence
  misc_feature (409)..(1260): KchPae283 sequence
atgaaacaccaccaccaccaccaccaccacggtggtctggttccgcgtggttcccatggcatgtttgtaacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatgtgaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaatccaccaggactacggcgacctgctggcctacatcgaatggggcttcaccggcatcttcctggtggaatacctgctgcgcctgtactgctcgcccaagccgctgcgctatgccttcagcttctacggcctggtcgacctgctggcgatcctccccggcttcctygccctgctctaccccgacgcccagtacctgctgatcgtccgggtgatacgcatgctgcggatcttccgcgtgctcaagctacgccagtacctgagccaggccaatttcctgctcaccgccctgcgcggcagcaagcagaagatcatcgtgttcttcctcaccgtgatgaccctggtcaccgtgttcggcgcgctgatgtacgtggtcgaaggcccggagcacggtttcaccagcatcccgcgcggcatctactgggcgatcgtcaccctgaccacggtcggcttcggcgacatcaccccgaagaccccgctcggccaggccatcgccagcctggtgatgctcaccggctactcgatcatcgcggtgcccaccgggatcttcaccgccgaactcgccaccgcgatgcgccaggacccggccaacctgttgcagcgggattgcccggtgtgccgcaaggcgacccacgaagtgcaggcggcattctgctgccgctgcggcaacccgttgttccctcgcgaggaagacagccatgggaagtcttga

SEQ ID NO: 76 - protein, 419 aa, Artificial Sequence
  MISTIC fusion protein / protein domain pMistic(C3V/S58C)-Thr-KchPae283
  MISC_FEATURE (1)..(20): octa-his sequence
  MISC_FEATURE (21)..(130): Mistic mutant sequence
  MISC_FEATURE (131)..(136): Thr sequence
  MISC_FEATURE (137)..(419): KchPae283 sequence
MKHHHHHHHHGGLVPRGSHGMFVTFFEKHHRKWDILLEKSTGVMEAMKVTSEEKEQLSTAIDRMNEGLDAFIQLYNECEIDEPLIQLDDDTAELMKQARDMYGQEKLNEKLNTIIKQILSISVSEEGEKELVPRGSMSAPDSWRERLYIVIFQTDTRDGRRFDSALLLVILASLLVVMIDSIDEIHQDYGDLLAYIEWGFTGIFLVEYLLRLYCSPKPLRYAFSFYGLVDLLAILPGFLALLYPDAQYLLIVRVIRMLRIFRVLKLRQYLSQANFLLTALRGSKQKIIVFFLTVMTLVTVFGALMYVVEGPEHGFTSIPRGIYWAIVTLTTVGFGDITPKTPLGQAIASLVMLTGYSIIAVPTGIFTAELATAMRQDPANLLQRDCPVCRKATHEVQAAFCCRCGNPLFPREEDSHGKS

SEQ ID NO: 77 - DNA, 1260 bp, Artificial Sequence
  MISTIC fusion protein / protein domain pMistic(C3V/N88C)-Thr-KchPae283
  misc_feature (1)..(60): octa-his sequence
  misc_feature (61)..(390): Mistic mutant sequence
  misc_feature (391)..(408): Thr sequence
  misc_feature (409)..(1260): KchPae283 sequence
atgaaacaccaccaccaccaccaccaccacggtggtctggttccgcgtggttcccatggcatgtttgtaacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctatgtgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaatccaccaggactacggcgacctgctggcctacatcgaatggggcttcaccggcatcttcctggtggaatacctgctgcgcctgtactgctcgcccaagccgctgcgctatgccttcagcttctacggcctggtcgacctgctggcgatcctccccggcttcctygccctgctctaccccgacgcccagtacctgctgatcgtccgggtgatacgcatgctgcggatcttccgcgtgctcaagctacgccagtacctgagccaggccaatttcctgctcaccgccctgcgcggcagcaagcagaagatcatcgtgttcttcctcaccgtgatgaccctggtcaccgtgttcggcgcgctgatgtacgtggtcgaaggcccggagcacggtttcaccagcatcccgcgcggcatctactgggcgatcgtcaccctgaccacggtcggcttcggcgacatcaccccgaagaccccgctcggccaggccatcgccagcctggtgatgctcaccggctactcgatcatcgcggtgcccaccgggatcttcaccgccgaactcgccaccgcgatgcgccaggacccggccaacctgttgcagcgggattgcccggtgtgccgcaaggcgacccacgaagtgcaggcggcattctgctgccgctgcggcaacccgttgttccctcgcgaggaagacagccatgggaagtcttga

SEQ ID NO: 78 - protein, 419 aa, Artificial Sequence
  MISTIC fusion protein / protein domain pMistic(C3V/N88C)-Thr-KchPae283
  MISC_FEATURE (1)..(20): octa-his sequence
  MISC_FEATURE (21)..(130): Mistic mutant sequence
  MISC_FEATURE (131)..(136): Thr sequence
  MISC_FEATURE (137)..(419): KchPae283 sequence
MKHHHHHHHHGGLVPRGSHGMFVTFFEKHHRKWDILLEKSTGVMEAMKVTSEEKEQLSTAIDRMNEGLDAFIQLYNESEIDEPLIQLDDDTAELMKQARDMYGQEKLCEKLNTIIKQILSISVSEEGEKELVPRGSMSAPDSWRERLYIVIFQTDTRDGRRFDSALLLVILASLLVVMIDSIDEIHQDYGDLLAYIEWGFTGIFLVEYLLRLYCSPKPLRYAFSFYGLVDLLAILPGFLALLYPDAQYLLIVRVIRMLRIFRVLKLRQYLSQANFLLTALRGSKQKIIVFFLTVMTLVTVFGALMYVVEGPEHGFTSIPRGIYWAIVTLTTVGFGDITPKTPLGQAIASLVMLTGYSIIAVPTGIFTAELATAMRQDPANLLQRDCPVCRKATHEVQAAFCCRCGNPLFPREEDSHGKS

SEQ ID NO: 79 - DNA, 1260 bp, Artificial Sequence
  MISTIC fusion protein / protein domain pMistic(C3V/E110C)-Thr-KchPae283
  misc_feature (1)..(60): octa-his sequence
  misc_feature (61)..(390): Mistic mutant sequence
  misc_feature (391)..(408): Thr sequence
  misc_feature (409)..(1260): KchPae283 sequence
atgaaacaccaccaccaccaccaccaccacggtggtctggttccgcgtggttcccatggcatgtttgtaacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaatgtctagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaatccaccaggactacggcgacctgctggcctacatcgaatggggcttcaccggcatcttcctggtggaatacctgctgcgcctgtactgctcgcccaagccgctgcgctatgccttcagcttctacggcctggtcgacctgctggcgatcctccccggcttcctygccctgctctaccccgacgcccagtacctgctgatcgtccgggtgatacgcatgctgcggatcttccgcgtgctcaagctacgccagtacctgagccaggccaatttcctgctcaccgccctgcgcggcagcaagcagaagatcatcgtgttcttcctcaccgtgatgaccctggtcaccgtgttcggcgcgctgatgtacgtggtcgaaggcccggagcacggtttcaccagcatcccgcgcggcatctactgggcgatcgtcaccctgaccacggtcggcttcggcgacatcaccccgaagaccccgctcggccaggccatcgccagcctggtgatgctcaccggctactcgatcatcgcggtgcccaccgggatcttcaccgccgaactcgccaccgcgatgcgccaggacccggccaacctgttgcagcgggattgcccggtgtgccgcaaggcgacccacgaagtgcaggcggcattctgctgccgctgcggcaacccgttgttccctcgcgaggaagacagccatgggaagtcttga

SEQ ID NO: 80 - protein, 419 aa, Artificial Sequence
  MISTIC fusion protein / protein domain pMistic(C3V/E110C)-Thr-KchPae283
  MISC_FEATURE (1)..(20): octa-his sequence
  MISC_FEATURE (21)..(130): Mistic mutant sequence
  MISC_FEATURE (131)..(136): Thr sequence
  MISC_FEATURE (137)..(419): KchPae283 sequence
MKHHHHHHHHGGLVPRGSHGMFVTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKCLVPRGSMSAPDSWRERLYIVIFQTDTRDGRRFDSALLLVILASLLVVMIDSIDEIHQDYGDLLAYIEWGFTGIFLVEYLLRLYCSPKPLRYAFSFYGLVDLLAILPGFLALLYPDAQYLLIVRVIRMLRIFRVLKLRQYLSQANFLLTALRGSKQKIIVFFLTVMTLVTVFGALMYVVEGPEHGFTSIPRGIYWAIVTLTTVGFGDITPKTPLGQAIASLVMLTGYSIIAVPTGIFTAELATAMRQDPANLLQRDCPVCRKATHEVQAAFCCRCGNPLFPREEDSHGKS

SEQ ID NO: 81 - DNA, 1395 bp, Artificial Sequence
  MISTIC fusion protein / protein domain pMistic(EK)-aKv1.1detlaT1
  misc_feature (1)..(60): octa-his sequence
  misc_feature (61)..(390): Mistic mutant sequence
  misc_feature (391)..(1395): aKv1.1deltaT1 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaaagagtgtggctgttgtttgagtaccctgagagctcagcggctgccaggctctgcgccatcttctctgtagtcattatccttttgtccattgttatattctgtttggagactttaccacaattcaagcattacagggtggtcaactcgacggccaatgattcgaaagagtccattgaggaggatgatattccaaagttcaatgagcccttcttcatcattgagacctgttgcatcatctggttcacatttgagcttttggtgaggtttgcttcgtgcccagagaagctcggcttcttcaagaacatcatgaactgcattgacattgtcgctatcattccatacttcatcactctgggcacggtggtggccgaccagagcaagagcaataatcaagccatgtctctggccatcctcagggtcatccgattggtcagggtcttcaggatattcaaactttccagacactcgaaaggccttcagatcctaggccagaccctcaaagccagtatgcgagaactgggcctgctcatattcttcctcttcataggtgttattttgttttccagtgctgtctactttgccgaggctgacgccgaccagacccactttaaaagtattcccgatgcattcttctgggccgtggtcaccatgacgacggtgggctacggagacatgcggccgatcggggtgtggggcaagctggttggctctctgtgcgccatcgctggcgtgctcacgatcgcgcttcctgtccctgtcattgtgtctaatttcaactatttctaccatcgagaaggggagagcactgacaagggacagtacaagcacgtgcagtcctgccccaactaccccgagaaaaaagattctttggattctgagtgcggctcggatatcatggagatggaggagggcaaccacagcactccgctgacggagaaggtgaaagagaaccatgcaatcaaggccaataaccccggcagtgactacgggctggagactgacgta

SEQ ID NO: 82 - protein, 465 aa, Artificial Sequence
  MISTIC fusion protein / protein domain pMistic(EK)-aKv1.1detlaT1
  MISC_FEATURE (1)..(20): octa-his sequence
  MISC_FEATURE (21)..(130): Mistic mutant sequence
  MISC_FEATURE (131)..(465): aKv1.1deltaT1 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSDDDDKERVWLLFEYPESSAAARLCAIFSVVIILLSIVIFCLETLPQFKHYRVVNSTANDSKESIEEDDIPKFNEPFFIIETCCIIWFTFELLVRFASCPEKLGFFKNIMNCIDIVAIIPYFITLGTVVADQSKSNNQAMSLAILRVIRLVRVFRIFKLSRHSKGLQILGQTLKASMRELGLLIFFLFIGVILFSSAVYFAEADADQTHFKSIPDAFFWAVVTMTTVGYGDMRPIGVWGKLVGSLCAIAGVLTIALPVPVIVSNFNYFYHREGESTDKGQYKHVQSCPNYPEKKDSLDSECGSDIMEMEEGNHSTPLTEKVKENHAIKANNPGSDYGLETDV

SEQ ID NO: 83 - DNA, 1395 bp, Artificial Sequence
  MISTIC fusion protein / protein domain pMistic(EK/W13A)-aKv1.1deltaT1
  misc_feature (1)..(60): octa-his sequence
  misc_feature (61)..(390): Mistic mutant sequence
  misc_feature (391)..(1395): aKv1.1deltaT1 sequence
atgaaacaccaccaccaccaccaccaccacggtggtctggttccgcgtggttcccatggcatgttttgtacattttttgaaaaacatcaccggaaggcggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaaagagtgtggctgttgtttgagtaccctgagagctcagcggctgccaggctctgcgccatcttctctgtagtcattatccttttgtccattgttatattctgtttggagactttaccacaattcaagcattacagggtggtcaactcgacggccaatgattcgaaagagtccattgaggaggatgatattccaaagttcaatgagcccttcttcatcattgagacctgttgcatcatctggttcacatttgagcttttggtgaggtttgcttcgtgcccagagaagctcggcttcttcaagaacatcatgaactgcattgacattgtcgctatcattccatacttcatcactctgggcacggtggtggccgaccagagcaagagcaataatcaagccatgtctctggccatcctcagggtcatccgattggtcagggtcttcaggatattcaaactttccagacactcgaaaggccttcagatcctaggccagaccctcaaagccagtatgcgagaactgggcctgctcatattcttcctcttcataggtgttattttgttttccagtgctgtctactttgccgaggctgacgccgaccagacccactttaaaagtattcccgatgcattcttctgggccgtggtcaccatgacgacggtgggctacggagacatgcggccgatcggggtgtggggcaagctggttggctctctgtgcgccatcgctggcgtgctcacgatcgcgcttcctgtccctgtcattgtgtctaatttcaactatttctaccatcgagaaggggagagcactgacaagggacagtacaagcacgtgcagtcctgccccaactaccccgagaaaaaagattctttggattctgagtgcggctcggatatcatggagatggaggagggcaaccacagcactccgctgacggagaaggtgaaagagaaccatgcaatcaaggccaataaccccggcagtgactacgggctggagactgacgta

SEQ ID NO: 84 - protein, 465 aa, Artificial Sequence
  MISTIC fusion protein / protein domain pMistic(EK/W13A)-aKv1.1deltaT1
  MISC_FEATURE (1)..(20): octa-his sequence
  MISC_FEATURE (21)..(130): Mistic mutant sequence
  MISC_FEATURE (131)..(465): aKv1.1deltaT1 sequence
MKHHHHHHHHGGLVPRGSHGMFCTFFEKHHRKADILLEKSTGVMEAMKVTSEEKEQLSTAIDRMNEGLDAFIQLYNESEIDEPLIQLDDDTAELMKQARDMYGQEKLNEKLNTIIKQILSISVSDDDDKERVWLLFEYPESSAAARLCAIFSVVIILLSIVIFCLETLPQFKHYRVVNSTANDSKESIEEDDIPKFNEPFFIIETCCIIWFTFELLVRFASCPEKLGFFKNIMNCIDIVAIIPYFITLGTVVADQSKSNNQAMSLAILRVIRLVRVFRIFKLSRHSKGLQILGQTLKASMRELGLLIFFLFIGVILFSSAVYFAEADADQTHFKSIPDAFFWAVVTMTTVGYGDMRPIGVWGKLVGSLCAIAGVLTIALPVPVIVSNFNYFYHREGESTDKGQYKHVQSCPNYPEKKDSLDSECGSDIMEMEEGNHSTPLTEKVKENHAIKANNPGSDYGLETDV

SEQ ID NO: 85 - DNA, 1395 bp, Artificial Sequence
  MISTIC fusion protein / protein domain pMistic(EK/Q36E)-aKv1.1deltaT1
  misc_feature (1)..(60): octa-his sequence
  misc_feature (61)..(390): Mistic mutant sequence
  misc_feature (391)..(1395): aKv1.1deltaT1 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaagagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaaagagtgtggctgttgtttgagtaccctgagagctcagcggctgccaggctctgcgccatcttctctgtagtcattatccttttgtccattgttatattctgtttggagactttaccacaattcaagcattacagggtggtcaactcgacggccaatgattcgaaagagtccattgaggaggatgatattccaaagttcaatgagcccttcttcatcattgagacctgttgcatcatctggttcacatttgagcttttggtgaggtttgcttcgtgcccagagaagctcggcttcttcaagaacatcatgaactgcattgacattgtcgctatcattccatacttcatcactctgggcacggtggtggccgaccagagcaagagcaataatcaagccatgtctctggccatcctcagggtcatccgattggtcagggtcttcaggatattcaaactttccagacactcgaaaggccttcagatcctaggccagaccctcaaagccagtatgcgagaactgggcctgctcatattcttcctcttcataggtgttattttgttttccagtgctgtctactttgccgaggctgacgccgaccagacccactttaaaagtattcccgatgcattcttctgggccgtggtcaccatgacgacggtgggctacggagacatgcggccgatcggggtgtggggcaagctggttggctctctgtgcgccatcgctggcgtgctcacgatcgcgcttcctgtccctgtcattgtgtctaatttcaactatttctaccatcgagaaggggagagcactgacaagggacagtacaagcacgtgcagtcctgccccaactaccccgagaaaaaagattctttggattctgagtgcggctcggatatcatggagatggaggagggcaaccacagcactccgctgacggagaaggtgaaagagaaccatgcaatcaaggccaataaccccggcagtgactacgggctggagactgacgta

SEQ ID NO: 86 - protein, 465 aa, Artificial Sequence
  MISTIC fusion protein / protein domain pMistic(EK/Q36E)-aKv1.1deltaT1
  MISC_FEATURE (1)..(20): octa-his sequence
  MISC_FEATURE (21)..(130): Mistic mutant sequence
  MISC_FEATURE (131)..(465): aKv1.1deltaT1 sequence
MKHHHHHHHHGGLVPRGSHGMFCTFFEKHHRKWDILLEKSTGVMEAMKVTSEEKEELSTAIDRMNEGLDAFIQLYNESEIDEPLIQLDDDTAELMKQARDMYGQEKLNEKLNTIIKQILSISVSDDDDKERVWLLFEYPESSAAARLCAIFSVVIILLSIVIFCLETLPQFKHYRVVNSTANDSKESIEEDDIPKFNEPFFIIETCCIIWFTFELLVRFASCPEKLGFFKNIMNCIDIVAIIPYFITLGTVVADQSKSNNQAMSLAILRVIRLVRVFRIFKLSRHSKGLQILGQTLKASMRELGLLIFFLFIGVILFSSAVYFAEADADQTHFKSIPDAFFWAVVTMTTVGYGDMRPIGVWGKLVGSLCAIAGVLTIALPVPVIVSNFNYFYHREGESTDKGQYKHVQSCPNYPEKKDSLDSECGSDIMEMEEGNHSTPLTEKVKENHAIKANNPGSDYGLETDV

SEQ ID NO: 87 - DNA, 1395 bp, Artificial Sequence
  MISTIC fusion protein / protein domain pMistic(EK/M75A)-aKv1.1deltaT1
  misc_feature (1)..(60): octa-his sequence
  misc_feature (61)..(390): Mistic mutant sequence
  misc_feature (391)..(1395): aKv1.1deltaT1 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttagcgaagcaggcccgagatatgtacggccaggaaaagctaaatgagaaattaaatacaattattaaacagattttatccatctcagtatctgacgacgacgacaaagaaagagtgtggctgttgtttgagtaccctgagagctcagcggctgccaggctctgcgccatcttctctgtagtcattatccttttgtccattgttatattctgtttggagactttaccacaattcaagcattacagggtggtcaactcgacggccaatgattcgaaagagtccattgaggaggatgatattccaaagttcaatgagcccttcttcatcattgagacctgttgcatcatctggttcacatttgagcttttggtgaggtttgcttcgtgcccagagaagctcggcttcttcaagaacatcatgaactgcattgacattgtcgctatcattccatacttcatcactctgggcacggtggtggccgaccagagcaagagcaataatcaagccatgtctctggccatcctcagggtcatccgattggtcagggtcttcaggatattcaaactttccagacactcgaaaggccttcagatcctaggccagaccctcaaagccagtatgcgagaactgggcctgctcatattcttcctcttcataggtgttattttgttttccagtgctgtctactttgccgaggctgacgccgaccagacccactttaaaagtattcccgatgcattcttctgggccgtggtcaccatgacgacggtgggctacggagacatgcggccgatcggggtgtggggcaagctggttggctctctgtgcgccatcgctggcgtgctcacgatcgcgcttcctgtccctgtcattgtgtctaatttcaactatttctaccatcgagaaggggagagcactgacaagggacagtacaagcacgtgcagtcctgccccaactaccccgagaaaaaagattctttggattctgagtgcggctcggatatcatggagatggaggagggcaaccacagcactccgctgacggagaaggtgaaagagaaccatgcaatcaaggccaataaccccggcagtgactacgggctggagactgacgta

SEQ ID NO: 88 - protein, 465 aa, Artificial Sequence
  MISTIC fusion protein / protein domain pMistic(EK/M75A)-aKv1.1deltaT1
  MISC_FEATURE (1)..(20): octa-his sequence
  MISC_FEATURE (21)..(130): Mistic mutant sequence
  MISC_FEATURE (131)..(465): aKv1.1deltaT1 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELAKQARDMYGQEKLNEKLNTIIKQILSISVSDDDDKERVWLLFEYPESSAAARLCAIFSVVIILLSIVIFCLETLPQFKHYRVVNSTANDSKESIEEDDIPKFNEPFFIIETCCIIWFTFELLVRFASCPEKLGFFKNIMNCIDIVAIIPYFITLGTVVADQSKSNNQAMSLAILRVIRLVRVFRIFKLSRHSKGLQILGQTLKASMRELGLLIFFLFIGVILFSSAVYFAEADADQTHFKSIPDAFFWAVVTMTTVGYGDMRPIGVWGKLVGSLCAIAGVLTIALPVPVIVSNFNYFYHREGESTDKGQYKHVQSCPNYPEKKDSLDSECGSDIMEMEEGNHSTPLTEKVKENHAIKANNPGSDYGLETDV

SEQ ID NO: 89 - DNA, 1743 bp, Artificial Sequence
  MISTIC fusion protein / protein domain pMistic(EK)-aKv1.1
  misc_feature (1)..(60): octa-his sequence
  misc_feature (61)..(390): Mistic mutant sequence
  misc_feature (391)..(1743): aKv1.1 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaaatggagcgcgtggtgatcaacgtgagcggtctccggttcgagacgcagctgaaaaccctcaaccagttccccgatacgttgcttggcaatcctcaaaagcgaaaccgctattacgacccacttcgcaacgagtattactttgacaggaatcgacccagttttgacgcaatcttgtatttctaccagagcggcggccggttacggaggcccgtgaacgttcccttggatgtgttctcagaggagatcaagttttatgagctgggagagaatgcctttgagaggtacagagaagatgagggcttcatcaaagaggaagagaagcctttgccacagaatgagtttcagaggagagtgtggctgttgtttgagtaccctgagagctcagcggctgccaggctctgcgccatcttctctgtagtcattatccttttgtccattgttatattctgtttggagactttaccacaattcaagcattacagggtggtcaactcgacggccaatgattcgaaagagtccattgaggaggatgatattccaaagttcaatgagcccttcttcatcattgagacctgttgcatcatctggttcacatttgagcttttggtgaggtttgcttcgtgcccagagaagctcggcttcttcaagaacatcatgaactgcattgacattgtcgctatcattccatacttcatcactctgggcacggtggtggccgaccagagcaagagcaataatcaagccatgtctctggccatcctcagggtcatccgattggtcagggtcttcaggatattcaaactttccagacactcgaaaggccttcagatcctaggccagaccctcaaagccagtatgcgagaactgggcctgctcatattcttcctcttcataggtgttattttgttttccagtgctgtctactttgccgaggctgacgccgaccagacccactttaaaagtattcccgatgcattcttctgggccgtggtcaccatgacgacggtgggctacggagacatgcggccgatcggggtgtggggcaagctggttggctctctgtgcgccatcgctggcgtgctcacgatcgcgcttcctgtccctgtcattgtgtctaatttcaactatttctaccatcgagaaggggagagcactgacaagggacagtacaagcacgtgcagtcctgccccaactaccccgagaaaaaagattctttggattctgagtgcggctcggatatcatggagatggaggagggcaaccacagcactccgctgacggagaaggtgaaagagaaccatgcaatcaaggccaataaccccggcagtgactacgggctggagactgacgta

SEQ ID NO: 90 - protein, 581 aa, Artificial Sequence
  MISTIC fusion protein / protein domain pMistic(EK)-aKv1.1
  MISC_FEATURE (1)..(20): octa-his sequence
  MISC_FEATURE (21)..(130): Mistic mutant sequence
  MISC_FEATURE (131)..(581): aKv1.1 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSDDDDKEMERVVINVSGLRFETQLKTLNQFPDTLLGNPQKRNRYYDPLRNEYYFDRNRPSFDAILYFYQSGGRLRRPVNVPLDVFSEEIKFYELGENAFERYREDEGFIKEEEKPLPQNEFQRRVWLLFEYPESSAAARLCAIFSVVIILLSIVIFCLETLPQFKHYRVVNSTANDSKESIEEDDIPKFNEPFFIIETCCIIWFTFELLVRFASCPEKLGFFKNIMNCIDIVAIIPYFITLGTVVADQSKSNNQAMSLAILRVIRLVRVFRIFKLSRHSKGLQILGQTLKASMRELGLLIFFLFIGVILFSSAVYFAEADADQTHFKSIPDAFFWAVVTMTTVGYGDMRPIGVWGKLVGSLCAIAGVLTIALPVPVIVSNFNYFYHREGESTDKGQYKHVQSCPNYPEKKDSLDSECGSDIMEMEEGNHSTPLTEKVKENHAIKANNPGSDYGLETDV

SEQ ID NO: 91 - DNA, 1758 bp, Artificial Sequence
  MISTIC fusion protein / protein domain pMistic(EK)-L-aKv1.1(delta1-6)
  misc_feature (1)..(60): octa-his sequence
  misc_feature (61)..(390): Mistic mutant sequence
  misc_feature (391)..(423): L sequence
  misc_feature (424)..(1758): aKv1.1(delta1-6) sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaaggctcctctggcagcagcggttcctcactagtcaacgtgagcggtctccggttcgagacgcagctgaaaaccctcaaccagttccccgatacgttgcttggcaatcctcaaaagcgaaaccgctattacgacccacttcgcaacgagtattactttgacaggaatcgacccagttttgacgcaatcttgtatttctaccagagcggcggccggttacggaggcccgtgaacgttcccttggatgtgttctcagaggagatcaagttttatgagctgggagagaatgcctttgagaggtacagagaagatgagggcttcatcaaagaggaagagaagcctttgccacagaatgagtttcagaggagagtgtggctgttgtttgagtaccctgagagctcagcggctgccaggctctgcgccatcttctctgtagtcattatccttttgtccattgttatattctgtttggagactttaccacaattcaagcattacagggtggtcaactcgacggccaatgattcgaaagagtccattgaggaggatgatattccaaagttcaatgagcccttcttcatcattgagacctgttgcatcatctggttcacatttgagcttttggtgaggtttgcttcgtgcccagagaagctcggcttcttcaagaacatcatgaactgcattgacattgtcgctatcattccatacttcatcactctgggcacggtggtggccgaccagagcaagagcaataatcaagccatgtctctggccatcctcagggtcatccgattggtcagggtcttcaggatattcaaactttccagacactcgaaaggccttcagatcctaggccagaccctcaaagccagtatgcgagaactgggcctgctcatattcttcctcttcataggtgttattttgttttccagtgctgtctactttgccgaggctgacgccgaccagacccactttaaaagtattcccgatgcattcttctgggccgtggtcaccatgacgacggtgggctacggagacatgcggccgatcggggtgtggggcaagctggttggctctctgtgcgccatcgctggcgtgctcacgatcgcgcttcctgtccctgtcattgtgtctaatttcaactatttctaccatcgagaaggggagagcactgacaagggacagtacaagcacgtgcagtcctgccccaactaccccgagaaaaaagattctttggattctgagtgcggctcggatatcatggagatggaggagggcaaccacagcactccgctgacggagaaggtgaaagagaaccatgcaatcaaggccaataaccccggcagtgactacgggctggagactgacgta

SEQ ID NO: 92 - protein, 586 aa, Artificial Sequence
  MISTIC fusion protein / protein domain pMistic(EK)-L-aKv1.1(delta1-6)
  MISC_FEATURE (1)..(20): octa-his sequence
  MISC_FEATURE (21)..(130): Mistic mutant sequence
  MISC_FEATURE (131)..(141): L sequence
  MISC_FEATURE (142)..(586): aKv1.1(delta1-6) sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSDDDDKEGSSGSSGSSLVNVSGLRFETQLKTLNQFPDTLLGNPQKRNRYYDPLRNEYYFDRNRPSFDAILYFYQSGGRLRRPVNVPLDVFSEEIKFYELGENAFERYREDEGFIKEEEKPLPQNEFQRRVWLLFEYPESSAAARLCAIFSVVIILLSIVIFCLETLPQFKHYRVVNSTANDSKESIEEDDIPKFNEPFFIIETCCIIWFTFELLVRFASCPEKLGFFKNIMNCIDIVAIIPYFITLGTVVADQSKSNNQAMSLAILRVIRLVRVFRIFKLSRHSKGLQILGQTLKASMRELGLLIFFLFIGVILFSSAVYFAEADADQTHFKSIPDAFFWAVVTMTTVGYGDMRPIGVWGKLVGSLCAIAGVLTIALPVPVIVSNFNYFYHREGESTDKGQYKHVQSCPNYPEKKDSLDSECGSDIMEMEEGNHSTPLTEKVKENHAIKANNPGSDYGLETDV

SEQ ID NO: 93 - DNA, 1767 bp, Artificial Sequence
  MISTIC fusion protein / protein domain pMistic(EK)-LI-aKv1.1(delta1)
  misc_feature (1)..(60): octa-his sequence
  misc_feature (61)..(390): Mistic mutant sequence
  misc_feature (391)..(417): LI sequence
  misc_feature (418)..(1767): aKv1.1(delta1) sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaaggctcctctggcagcagcggttcctcagagcgcgtggtgatcaacgtgagcggtctccggttcgagacgcagctgaaaaccctcaaccagttccccgatacgttgcttggcaatcctcaaaagcgaaaccgctattacgacccacttcgcaacgagtattactttgacaggaatcgacccagttttgacgcaatcttgtatttctaccagagcggcggccggttacggaggcccgtgaacgttcccttggatgtgttctcagaggagatcaagttttatgagctgggagagaatgcctttgagaggtacagagaagatgagggcttcatcaaagaggaagagaagcctttgccacagaatgagtttcagaggagagtgtggctgttgtttgagtaccctgagagctcagcggctgccaggctctgcgccatcttctctgtagtcattatccttttgtccattgttatattctgtttggagactttaccacaattcaagcattacagggtggtcaactcgacggccaatgattcgaaagagtccattgaggaggatgatattccaaagttcaatgagcccttcttcatcattgagacctgttgcatcatctggttcacatttgagcttttggtgaggtttgcttcgtgcccagagaagctcggcttcttcaagaacatcatgaactgcattgacattgtcgctatcattccatacttcatcactctgggcacggtggtggccgaccagagcaagagcaataatcaagccatgtctctggccatcctcagggtcatccgattggtcagggtcttcaggatattcaaactttccagacactcgaaaggccttcagatcctaggccagaccctcaaagccagtatgcgagaactgggcctgctcatattcttcctcttcataggtgttattttgttttccagtgctgtctactttgccgaggctgacgccgaccagacccactttaaaagtattcccgatgcattcttctgggccgtggtcaccatgacgacggtgggctacggagacatgcggccgatcggggtgtggggcaagctggttggctctctgtgcgccatcgctggcgtgctcacgatcgcgcttcctgtccctgtcattgtgtctaatttcaactatttctaccatcgagaaggggagagcactgacaagggacagtacaagcacgtgcagtcctgccccaactaccccgagaaaaaagattctttggattctgagtgcggctcggatatcatggagatggaggagggcaaccacagcactccgctgacggagaaggtgaaagagaaccatgcaatcaaggccaataaccccggcagtgactacgggctggagactgacgta

SEQ ID NO: 94 - protein, 589 aa, Artificial Sequence
  MISTIC fusion protein / protein domain pMistic(EK)-LI-aKv1.1(delta1)
  MISC_FEATURE (1)..(20): octa-his sequence
  MISC_FEATURE (21)..(130): Mistic mutant sequence
  MISC_FEATURE (131)..(139): LI sequence
  MISC_FEATURE (140)..(589): aKv1.1(delta1) sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSDDDDKEGSSGSSGSSERVVINVSGLRFETQLKTLNQFPDTLLGNPQKRNRYYDPLRNEYYFDRNRPSFDAILYFYQSGGRLRRPVNVPLDVFSEEIKFYELGENAFERYREDEGFIKEEEKPLPQNEFQRRVWLLFEYPESSAAARLCAIFSVVIILLSIVIFCLETLPQFKHYRVVNSTANDSKESIEEDDIPKFNEPFFIIETCCIIWFTFELLVRFASCPEKLGFFKNIMNCIDIVAIIPYFITLGTVVADQSKSNNQAMSLAILRVIRLVRVFRIFKLSRHSKGLQILGQTLKASMRELGLLIFFLFIGVILFSSAVYFAEADADQTHFKSIPDAFFWAVVTMTTVGYGDMRPIGVWGKLVGSLCAIAGVLTIALPVPVIVSNFNYFYHREGESTDKGQYKHVQSCPNYPEKKDSLDSECGSDIMEMEEGNHSTPLTEKVKENHAIKANNPGSDYGLETDV

SEQ ID NO: 95 - DNA, 1809 bp, Artificial Sequence
  MISTIC fusion protein / protein domain pMistic(EK)-LINKER-aKv1.1
  misc_feature (1)..(60): octa-his sequence
  misc_feature (61)..(390): Mistic mutant sequence
  misc_feature (391)..(456): LINKER sequence
  misc_feature (457)..(1809): aKv1.1 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaaggctcctctggcagcagcggttcctcactagttccgcggggatcatccggtagctctggcagctccatggagcgcgtggtgatcaacgtgagcggtctccggttcgagacgcagctgaaaaccctcaaccagttccccgatacgttgcttggcaatcctcaaaagcgaaaccgctattacgacccacttcgcaacgagtattactttgacaggaatcgacccagttttgacgcaatcttgtatttctaccagagcggcggccggttacggaggcccgtgaacgttcccttggatgtgttctcagaggagatcaagttttatgagctgggagagaatgcctttgagaggtacagagaagatgagggcttcatcaaagaggaagagaagcctttgccacagaatgagtttcagaggagagtgtggctgttgtttgagtaccctgagagctcagcggctgccaggctctgcgccatcttctctgtagtcattatccttttgtccattgttatattctgtttggagactttaccacaattcaagcattacagggtggtcaactcgacggccaatgattcgaaagagtccattgaggaggatgatattccaaagttcaatgagcccttcttcatcattgagacctgttgcatcatctggttcacatttgagcttttggtgaggtttgcttcgtgcccagagaagctcggcttcttcaagaacatcatgaactgcattgacattgtcgctatcattccatacttcatcactctgggcacggtggtggccgaccagagcaagagcaataatcaagccatgtctctggccatcctcagggtcatccgattggtcagggtcttcaggatattcaaactttccagacactcgaaaggccttcagatcctaggccagaccctcaaagccagtatgcgagaactgggcctgctcatattcttcctcttcataggtgttattttgttttccagtgctgtctactttgccgaggctgacgccgaccagacccactttaaaagtattcccgatgcattcttctgggccgtggtcaccatgacgacggtgggctacggagacatgcggccgatcggggtgtggggcaagctggttggctctctgtgcgccatcgctggcgtgctcacgatcgcgcttcctgtccctgtcattgtgtctaatttcaactatttctaccatcgagaaggggagagcactgacaagggacagtacaagcacgtgcagtcctgccccaactaccccgagaaaaaagattctttggattctgagtgcggctcggatatcatggagatggaggagggcaaccacagcactccgctgacggagaaggtgaaagagaaccatgcaatcaaggccaataaccccggcagtgactacgggctggagactgacgta

SEQ ID NO: 96 - protein, 603 aa, Artificial Sequence
  MISTIC fusion protein / protein domain pMistic(EK)-LINKER-aKv1.1
  MISC_FEATURE (1)..(20): octa-his sequence
  MISC_FEATURE (21)..(130): Mistic mutant sequence
  MISC_FEATURE (131)..(152): LINKER sequence
  MISC_FEATURE (153)..(603): aKv1.1 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSDDDDKEGSSGSSGSSLVPRGSSGSSGSSMERVVINVSGLRFETQLKTLNQFPDTLLGNPQKRNRYYDPLRNEYYFDRNRPSFDAILYFYQSGGRLRRPVNVPLDVFSEEIKFYELGENAFERYREDEGFIKEEEKPLPQNEFQRRVWLLFEYPESSAAARLCAIFSVVIILLSIVIFCLETLPQFKHYRVVNSTANDSKESIEEDDIPKFNEPFFIIETCCIIWFTFELLVRFASCPEKLGFFKNIMNCIDIVAIIPYFITLGTVVADQSKSNNQAMSLAILRVIRLVRVFRIFKLSRHSKGLQILGQTLKASMRELGLLIFFLFIGVILFSSAVYFAEADADQTHFKSIPDAFFWAVVTMTTVGYGDMRPIGVWGKLVGSLCAIAGVLTIALPVPVIVSNFNYFYHREGESTDKGQYKHVQSCPNYPEKKDSLDSECGSDIMEMEEGNHSTPLTEKVKENHAIKANNPGSDYGLETDV

SEQ ID NO: 97 - DNA, 1917 bp, Artificial Sequence
  MISTIC fusion protein / protein domain pMistic(EK)-LINK-hKv1.5
  misc_feature (1)..(60): octa-his sequence
  misc_feature (61)..(390): Mistic mutant sequence
  misc_feature (391)..(435): LINK sequence
  misc_feature (436)..(1917): hKv1.5 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaaggctcctctggcagcagcggttcctcactagttccgcgtgtttcccagcgcgtccacatcaacatctccgggctgcgctttgagacgcagctgggcaccctggcgcagttccccaacacactcctgggggaccccgccaagcgcctgcgctacttcgaccccctgaggaacgagtacttcttcgaccgcaaccggcccagcttcgacggtatcctctactactaccagtccgggggccgcctgcggaggccggtcaacgtctccctggacgtgttcgcggacgagatacgcttctaccagctgggggacgaggccatggagcgcttccgcgaggatgagggcttcattaaagaagaggagaagcccctgccccgcaacgagttccagcgccaggtgtggcttatcttcgagtatccggagagctctgggtccgcgcgggccatcgccatcgtctcggtcttggttatcctcatctccatcatcaccttctgcttggagaccctgcctgagttcagggatgaacgtgagctgctccgccaccctccggcgccccaccagcctcccgcgcccgcccctggggccaacggcagcggggtcatggccccgccctctggccctacggtggcaccgctcctgcccaggaccctggccgaccccttcttcatcgtggagaccacgtgcgtcatctggttcaccttcgagctgctcgtgcgcttcttcgcctgccccagcaaggcagggttctcccggaacatcatgaacatcatcgatgtggtggccatcttcccctacttcatcaccctgggcaccgaactggcagagcagcagccagggggtggaggaggcggccagaatgggcagcaggccatgtccctggccatcctccgagtcatccgcctggtccgggtgttccgcatcttcaagctctcccgccactccaaggggctgcagatcctgggcaagaccttgcaggcctccatgagggagctggggctgctcatcttcttcctcttcatcggggtcatcctcttctccagtgccgtctacttcgcagaggctgacaaccagggaacccatttctctagcatccctgacgccttctggtgggcagtggtcaccatgaccactgtgggctacggggacatgaggcccatcactgttgggggcaagatcgtgggctcgctgtgtgccatcgccggggtcctcaccattgccctgcctgtgcccgtcatcgtctccaacttcaactacttctaccaccgggaaacggatcacgaggagccggcagtccttaaggaagagcagggcactcagagccaggggccggggctggacagaggagtccagcggaaggtcagcgggagcaggggatccttctgcaaggctggggggaccctggagaatgcagacagtgcccgaaggggcagctgccccctagagaagtgtaacgtcaaggccaagagcaacgtggacttgcggaggtccctttatgccctctgcctggacaccagccgggaaacagatttg

SEQ ID NO: 98 - protein, 639 aa, Artificial Sequence
  MISTIC fusion protein / protein domain pMistic(EK)-LINK-hKv1.5
  MISC_FEATURE (1)..(20): octa-his sequence
  MISC_FEATURE (21)..(130): Mistic mutant sequence
  MISC_FEATURE (131)..(145): LINK sequence
  MISC_FEATURE (146)..(639): hKv1.5 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSDDDDKEGSSGSSGSSLVPRGSQRVHINISGLRFETQLGTLAQFPNTLLGDPAKRLRYFDPLRNEYFFDRNRPSFDGILYYYQSGGRLRRPVNVSLDVFADEIRFYQLGDEAMERFREDEGFIKEEEKPLPRNEFQRQVWLIFEYPESSGSARAIAIVSVLVILISIITFCLETLPEFRDERELLRHPPAPHQPPAPAPGANGSGVMAPPSGPTVAPLLPRTLADPFFIVETTCVIWFTFELLVRFFACPSKAGFSRNIMNIIDVVAIFPYFITLGTELAEQQPGGGGGGQNGQQAMSLAILRVIRLVRVFRIFKLSRHSKGLQILGKTLQASMRELGLLIFFLFIGVILFSSAVYFAEADNQGTHFSSIPDAFWWAVVTMTTVGYGDMRPITVGGKIVGSLCAIAGVLTIALPVPVIVSNFNYFYHRETDHEEPAVLKEEQGTQSQGPGLDRGVQRKVSGSRGSFCKAGGTLENADSARRGSCPLEKCNVKAKSNVDLRRSLYALCLDTSRETDL

SEQ ID NO: 99 - DNA, 2916 bp, Artificial Sequence
  MISTIC fusion protein / protein domain pMistic(EK)-LINK-rKv2.1
  misc_feature (1)..(60): octa-his sequence
  misc_feature (61)..(390): Mistic mutant sequence
  misc_feature (391)..(435): LINK sequence
  misc_feature (436)..(2916): rKv2.1 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaaggctcctctggcagcagcggttcctcactagttccgcgtgtttcccgccgggtgcgcctcaacgtcgggggcctggcgcacgaggtgctgtggcgcactctggaccgcctgccccgcacgcggctgggcaagcttcgggactgcaacacgcacgactccctgctccaggtgtgcgacgactacagccttgaggacaacgagtacttcttcgaccgccaccctggcgcctttacctccattctcaatttctaccgcaccggccggctgcacatgatggaggagatgtgcgcgctgagcttcagccaggagctggactactggggcatcgatgagatctacctggagtcctgctgccaggcccgctatcaccaaaagaaggagcagatgaacgaggagctgaagcgcgaggccgagacgctgcgggagcgggagggcgaggagtttgacaacacgtgctgtgcagagaagaggaagaaactctgggatctgctggagaagcccaactcgtcggtggccgccaagatcctggccatcatctcgatcatgttcatcgtcctgtccaccatcgctctgtcactcaacacgctgcctgagctgcagagcctagacgagttcggccagagcacggataacccgcagctggcgcacgtggaggcggtgtgcatcgcatggttcaccatggagtacttgctgaggttcctgtcctcccccaagaaatggaagttcttcaagggccccctcaacgccattgacctactggccatcctgccctactacgtcaccatcttcctcacagaatccaacaagagcgtgctgcagttccagaacgtgcgccgcgtggtccagatctttcgcatcatgcgcatccttcggatcctgaagctggcccgtcactccactggcctgcagtccttgggcttcaccctgcgcagaagctacaacgaactgggcctgctcatcctcttcctcgcgatgggcatcatgatcttctccagcctggtcttcttcgcggagaaggatgaggacgacaccaagttcaaaagcatccccgcctctttctggtgggctaccatcaccatgacaactgttggctatggagacatctacccgaagactctcctggggaaaatcgtgggggggctctgttgcattgccggggtcctggtgattgctctccccatccccatcatcgtcaataacttctccgagttctacaaggagcagaagcgccaggagaaagccatcaagcggagggaggctctggagagagccaagaggaatggcagcatcgtgtccatgaacatgaaggacgccttcgcccggagcatcgagatgatggacatcgtggtggagaaaaatggcgagagcatagctaagaaggataaagtgcaagataaccacctgtcccccaacaagtggaaatggaccaagagggcactctccgagaccagctccagtaagtcctttgaaaccaaggagcagggatcccccgaaaaggccaggtcctcgtctagtccacagcacttgaacgtccagcagctggaagacatgtacagtaagatggccaagacacagtcccagcccatcctcaacaccaaggagatggccccgcagagcaagcctccagaggagctggagatgagcagcatgcccagccccgtggcccctctgcccgcacgcacggagggcgtcatcgacatgcggagcatgtccagcattgacagcttcatcagctgtgccacggacttccctgaagccaccagattctcccacagtcctctggcatccctctccagcaaggctgggagcagcacagccccggaggtgggctggcggggggctctgggtgccagcggcgggaggctcacggagaccaaccccattcctgagaccagccgctctggtttcttcgtggagagtcccaggagttccatgaagaccaacaaccccttgaagctgcgagcgctcaaggtcaacttcgtggagggcgaccccaccccgctgctgccctccctgggcttgtatcacgatcctcttaggaacagaggaggggcagcggctgcagttgcgggactggagtgtgcctccctcttagacaagcccgtgctgagcccagagtcctccatctacaccacagcaagtgccaggacgccccctcgctcccctgagaaacacacagcaatagcattcaacttcgaggcgggagtccaccattacatagacaccgacacagatgacgagggtcagctgctctacagcgtggactccagccctcccaaaagtctccacgggagtaccagtcccaagttcagcactggagctagaacggagaagaaccacttcgagagctcccccttgcccacctcccctaagttcttaaggccgaactgtgtctactcctcagaagggttgactggaaaaggccctggggctcaagagaaatgcaagctggagaaccatacccccccggatgtgcacatgctgcctgggggaggagcacacgggagcactagggatcagagtatc

SEQ ID NO: 100 - protein, 972 aa, Artificial Sequence
  MISTIC fusion protein / protein domain pMistic(EK)-LINK-rKv2.1
  MISC_FEATURE (1)..(20): octa-his sequence
  MISC_FEATURE (21)..(130): Mistic mutant sequence
  MISC_FEATURE (131)..(145): LINK sequence
  MISC_FEATURE (146)..(972): rKv2.1 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSDDDDKEGSSGSSGSSLVPRGSRRVRLNVGGLAHEVLWRTLDRLPRTRLGKLRDCNTHDSLLQVCDDYSLEDNEYFFDRHPGAFTSILNFYRTGRLHMMEEMCALSFSQELDYWGIDEIYLESCCQARYHQKKEQMNEELKREAETLREREGEEFDNTCCAEKRKKLWDLLEKPNSSVAAKILAIISIMFIVLSTIALSLNTLPELQSLDEFGQSTDNPQLAHVEAVCIAWFTMEYLLRFLSSPKKWKFFKGPLNAIDLLAILPYYVTIFLTESNKSVLQFQNVRRVVQIFRIMRILRILKLARHSTGLQSLGFTLRRSYNELGLLILFLAMGIMIFSSLVFFAEKDEDDTKFKSIPASFWWATITMTTVGYGDIYPKTLLGKIVGGLCCIAGVLVIALPIPIIVNNFSEFYKEQKRQEKAIKRREALERAKRNGSIVSMNMKDAFARSIEMMDIVVEKNGESIAKKDKVQDNHLSPNKWKWTKRALSETSSSKSFETKEQGSPEKARSSSSPQHLNVQQLEDMYSKMAKTQSQPILNTKEMAPQSKPPEELEMSSMPSPVAPLPARTEGVIDMRSMSSIDSFISCATDFPEATRFSHSPLASLSSKAGSSTAPEVGWRGALGASGGRLTETNPIPETSRSGFFVESPRSSMKTNNPLKLRALKVNFVEGDPTPLLPSLGLYHDPLRNRGGAAAAVAGLECASLLDKPVLSPESSIYTTASARTPPRSPEKHTAIAFNFEAGVHHYIDTDTDDEGQLLYSVDSSPPKSLHGSTSPKFSTGARTEKNHFESSPLPTSPKFLRPNCVYSSEGLTGKGPGAQEKCKLENHTPPDVHMLPGGGAHGSTRDQSI

SEQ ID NO: 101 - DNA, 2190 bp, Artificial Sequence
  MISTIC fusion protein / protein domain pMistic(EK)-LINK-rKv3.1
  misc_feature (1)..(60): octa-his sequence
  misc_feature (61)..(390): Mistic mutant sequence
  misc_feature (391)..(435): LINK sequence
  misc_feature (436)..(2190): rKv3.1 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaaggctcctctggcagcagcggttcctcactagttccgcgtgtttccatgggccaaggggacgagagcgagcgcatcgtgatcaacgtgggcggcacgcgccaccagacgtaccgctcgacgctgcgcacgctgcccggcacgcggcttgcctggctggcggagccggacgcccacagccacttcgactatgacccgcgcgctgacgagttcttcttcgaccgccacccgggcgtcttcgctcacatcctgaactattaccgcaccggcaagctacactgcccggccgacgtgtgcgggccgctctacgaggaggagctggccttctggggcatcgacgagacggacgtggagccctgctgctggatgacgtatcgccagcaccgcgacgctgaggaggcgctggacagctttggtggcgcgcccttggacaacagcgccgacgacgcggacgccgacggccccggcgactcgggcgacggcgaggacgagctggagatgaccaagagattggcgctcagtgactccccagatggccggcctggcggcttctggcgccgctggcagccacgcatctgggcactgttcgaggacccctactcatcccgctatgcgcggtacgtggcctttgcctccctcttcttcatcctggtctccatcacaaccttctgtctggagacccacgagcgcttcaaccccatcgtgaacaagacagaaattgagaacgttcgaaatggcacacaagtgcggtactaccgggaagcggagacggaggccttcctcacctacatcgagggtgtctgcgtggtctggttcaccttcgagttcctcatgcgtgttgtcttctgtcccaacaaggtggagttcatcaagaactccctcaatatcattgacttcgtggccatcctccccttctacctggaggtgggcctaagtggcctgtcctccaaagctgccaaggacgtgctaggcttcctgcgcgtcgtgcgcttcgtgcgcatcctccgtatcttcaagctgacccgccattttgtgggcctgcgggtcctgggccacacgctccgtgccagcaccaacgagttcctgctgcttatcatcttcctggccctgggtgtgctcatctttgccaccatgatctactatgctgagaggataggggcacagcccaatgaccccagcgccagcgaacacacacactttaaaaatatccccatcggcttctggtgggctgtggtcaccatgacgacactgggctatggagacatgtatcctcagacgtggtctgggatgttggtgggagcactgtgcgccctggctggtgtgctgaccattgccatgccggtgcccgtcatcgtgaacaattttgggatgtactactctttagccatggctaagcagaaactaccaaagaaaaaaaagaagcatattccgcggccaccacagctgggatctcccaattattgtaaatctgtcgtaaactctccacaccacagtactcagagtgacacatgtccgctggcccaggaagaaattttagaaattaacagagcagattccaaactgaatggggaggtggcgaaggccgcgctggcgaacgaagactgcccccacatagaccaggccctcactcccgatgagggcctgccctttacccgctcgggcacccgcgagagatacggaccctgcttcctcttatcaaccggggagtacgcgtgcccgcctggtggaggaatgagaaaggatctttgcaaagaaagccctgtcattgctaagtatatgccgacagaggctgtgagagtgact

SEQ ID NO: 102 - protein, 730 aa, Artificial Sequence
  MISTIC fusion protein / protein domain pMistic(EK)-LINK-rKv3.1
  MISC_FEATURE (1)..(20): octa-his sequence
  MISC_FEATURE (21)..(130): Mistic mutant sequence
  MISC_FEATURE (131)..(145): LINK sequence
  MISC_FEATURE (146)..(730): rKv3.1 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSDDDDKEGSSGSSGSSLVPRGSMGQGDESERIVINVGGTRHQTYRSTLRTLPGTRLAWLAEPDAHSHFDYDPRADEFFFDRHPGVFAHILNYYRTGKLHCPADVCGPLYEEELAFWGIDETDVEPCCWMTYRQHRDAEEALDSFGGAPLDNSADDADADGPGDSGDGEDELEMTKRLALSDSPDGRPGGFWRRWQPRIWALFEDPYSSRYARYVAFASLFFILVSITTFCLETHERFNPIVNKTEIENVRNGTQVRYYREAETEAFLTYIEGVCVVWFTFEFLMRVVFCPNKVEFIKNSLNIIDFVAILPFYLEVGLSGLSSKAAKDVLGFLRVVRFVRILRIFKLTRHFVGLRVLGHTLRASTNEFLLLIIFLALGVLIFATMIYYAERIGAQPNDPSASEHTHFKNIPIGFWWAVVTMTTLGYGDMYPQTWSGMLVGALCALAGVLTIAMPVPVIVNNFGMYYSLAMAKQKLPKKKKKHIPRPPQLGSPNYCKSVVNSPHHSTQSDTCPLAQEEILEINRADSKLNGEVAKAALANEDCPHIDQALTPDEGLPFTRSGTRERYGPCFLLSTGEYACPPGGGMRKDLCKESPVIAKYMPTEAVRVT

SEQ ID NO: 103 - DNA, 1836 bp, Artificial Sequence
  MISTIC fusion protein / protein domain pMistic(EK)-LINK-rKv1.2
  misc_feature (1)..(60): octa-his sequence
  misc_feature (61)..(390): Mistic mutant sequence
  misc_feature (391)..(435): LINK sequence
  misc_feature (436)..(1836): rKv1.2 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaaggctcctctggcagcagcggttcctcactagttccgcgtgtttccgagagagtggtgattaacatctcaggcctgcggttcgagactcagctaaagaccttagcccagttcccagagaccctcttaggagaccccaagaaacggatgaggtactttgatcccctccgaaatgagtacttttttgatcgcaaccgccctagctttgatgccattttgtactactaccagtctgggggcaggttgaggcgacctgtgaatgtgcccttagatatcttctctgaagaaatccggttttatgagctaggagaagaggcaatggagatgtttcgggaggatgaaggctacatcaaggaagaagaacgtcccctgcctgaaaatgagtttcagagacaggtgtggcttctctttgaataccctgagagctcagggccggccaggatcatagccattgtatctgtgatggtcattctgatctcgatcgtcagcttctgtctggaaaccttgcccatcttccgggatgagaacgaggacatgcatggtggtggggtgaccttccacacctattccaacagcaccattgggtaccagcagtccacctccttcaccgaccctttcttcatcgtagagactctctgcatcatctggttctcctttgagtttctggttagattctttgcctgtcccagcaaagctggcttcttcaccaacatcatgaacatcattgacattgtggctatcatcccttactttatcaccctggggacagagttagctgagaagccagaggacgcccagcaaggccagcaggccatgtcactggccattctccgtgtcatccggttggtaagagtctttaggattttcaagttgtccagacactccaaaggtctgcagattctaggtcagaccctcaaagccagcatgagggaattgggcctcctgatattcttcctcttcattggggtcatcctcttctctagtgctgtctattttgcagaagytgatgagcgagattcccagttccccagcatcccggatgccttctggtgggcagtcgtctccatgacaactgtaggctatggagacatggttccaactaccattgggggaaagatagtgggttctctgtgtgcaattgcaggtgtgttaaccattgccttaccagtccctgtcatagtgtctaatttcaactacttctaccaccgggagacagagggagaggagcaggcccagtacttgcaagtgacaagttgtccaaagatcccgtcctcccctgacctaaagaaaagtagaagtgcctctaccataagtaagtctgattacatggagatacaggagggagtaaacaacagtaatgaggactttagagaggagaacttaaaaacagccaactgtaccttggctaacacaaactatgtgaatattaccaaaatgttaactgatgtc

SEQ ID NO: 104 - protein, 612 aa, Artificial Sequence
  MISTIC fusion protein / protein domain pMistic(EK)-LINK-rKv1.2
  MISC_FEATURE (1)..(20): octa-his sequence
  MISC_FEATURE (1)..(20): octa-his sequence
  MISC_FEATURE (21)..(130): Mistic mutant sequence
  MISC_FEATURE (131)..(145): LINK sequence
  MISC_FEATURE (146)..(612): rKv1.2 sequence
  MISC_FEATURE (464)..(464): Xaa = any amino acid
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSDDDDKEGSSGSSGSSLVPRGSERVVINISGLRFETQLKTLAQFPETLLGDPKKRMRYFDPLRNEYFFDRNRPSFDAILYYYQSGGRLRRPVNVPLDIFSEEIRFYELGEEAMEMFREDEGYIKEEERPLPENEFQRQVWLLFEYPESSGPARIIAIVSVMVILISIVSFCLETLPIFRDENEDMHGGGVTFHTYSNSTIGYQQSTSFTDPFFIVETLCIIWFSFEFLVRFFACPSKAGFFTNIMNIIDIVAIIPYFITLGTELAEKPEDAQQGQQAMSLAILRVIRLVRVFRIFKLSRHSKGLQILGQTLKASMRELGLLIFFLFIGVILFSSAVYFAEXDERDSQFPSIPDAFWWAVVSMTTVGYGDMVPTTIGGKIVGSLCAIAGVLTIALPVPVIVSNFNYFYHRETEGEEQAQYLQVTSCPKIPSSPDLKKSRSASTISKSDYMEIQEGVNNSNEDFREENLKTANCTLANTNYVNITKMLTDV

SEQ ID NO: 105 - DNA, 1848 bp, Artificial Sequence
  MISTIC fusion protein / protein domain pMistic(EK)-LINK2-rKv1.2
  misc_feature (1)..(60): octa-his sequence
  misc_feature (61)..(390): Mistic mutant sequence
  misc_feature (391)..(447): LINK2 sequence
  misc_feature (448)..(1848): rKv1.2 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaaggctcctctggcagcagcggttcctcactagttccgcgtgtttccggctcgagcggtgagagagtggtgattaacatctcaggcctgcggttcgagactcagctaaagaccttagcccagttcccagagaccctcttaggagaccccaagaaacggatgaggtactttgatcccctccgaaatgagtacttttttgatcgcaaccgccctagctttgatgccattttgtactactaccagtctgggggcaggttgaggcgacctgtgaatgtgcccttagatatcttctctgaagaaatccggttttatgagctaggagaagaggcaatggagatgtttcgggaggatgaaggctacatcaaggaagaagaacgtcccctgcctgaaaatgagtttcagagacaggtgtggcttctctttgaataccctgagagctcagggccggccaggatcatagccattgtatctgtgatggtcattctgatctcgatcgtcagcttctgtctggaaaccttgcccatcttccgggatgagaacgaggacatgcatggtggtggggtgaccttccacacctattccaacagcaccattgggtaccagcagtccacctccttcaccgaccctttcttcatcgtagagactctctgcatcatctggttctcctttgagtttctggttagattctttgcctgtcccagcaaagctggcttcttcaccaacatcatgaacatcattgacattgtggctatcatcccttactttatcaccctggggacagagttagctgagaagccagaggacgcccagcaaggccagcaggccatgtcactggccattctccgtgtcatccggttggtaagagtctttaggattttcaagttgtccagacactccaaaggtctgcagattctaggtcagaccctcaaagccagcatgagggaattgggcctcctgatattcttcctcttcattggggtcatcctcttctctagtgctgtctattttgcagaagytgatgagcgagattcccagttccccagcatcccggatgccttctggtgggcagtcgtctccatgacaactgtaggctatggagacatggttccaactaccattgggggaaagatagtgggttctctgtgtgcaattgcaggtgtgttaaccattgccttaccagtccctgtcatagtgtctaatttcaactacttctaccaccgggagacagagggagaggagcaggcccagtacttgcaagtgacaagttgtccaaagatcccgtcctcccctgacctaaagaaaagtagaagtgcctctaccataagtaagtctgattacatggagatacaggagggagtaaacaacagtaatgaggactttagagaggagaacttaaaaacagccaactgtaccttggctaacacaaactatgtgaatattaccaaaatgttaactgatgtc

SEQ ID NO: 106 - protein, 616 aa, Artificial Sequence
  MISTIC fusion protein / protein domain pMistic(EK)-LINK2-rKv1.2
  MISC_FEATURE (1)..(20): octa-his sequence
  MISC_FEATURE (1)..(20): octa-his sequence
  MISC_FEATURE (21)..(130): Mistic mutant sequence
  MISC_FEATURE (131)..(149): LINK2 sequence
  MISC_FEATURE (150)..(616): rKv1.2 sequence
  MISC_FEATURE (468)..(468): Xaa = any amino acid
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSDDDDKEGSSGSSGSSLVPRGSGSSGERVVINISGLRFETQLKTLAQFPETLLGDPKKRMRYFDPLRNEYFFDRNRPSFDAILYYYQSGGRLRRPVNVPLDIFSEEIRFYELGEEAMEMFREDEGYIKEEERPLPENEFQRQVWLLFEYPESSGPARIIAIVSVMVILISIVSFCLETLPIFRDENEDMHGGGVTFHTYSNSTIGYQQSTSFTDPFFIVETLCIIWFSFEFLVRFFACPSKAGFFTNIMNIIDIVAIIPYFITLGTELAEKPEDAQQGQQAMSLAILRVIRLVRVFRIFKLSRHSKGLQILGQTLKASMRELGLLIFFLFIGVILFSSAVYFAEXDERDSQFPSIPDAFWWAVVSMTTVGYGDMVPTTIGGKIVGSLCAIAGVLTIALPVPVIVSNFNYFYHRETEGEEQAQYLQVTSCPKIPSSPDLKKSRSASTISKSDYMEIQEGVNNSNEDFREENLKTANCTLANTNYVNITKMLTDV

SEQ ID NO: 107 - DNA, 2883 bp, Artificial Sequence
  MISTIC fusion protein / protein domain pMistic(EK)-LINK-GABABR1
  misc_feature (1)..(60): octa-his sequence
  misc_feature (61)..(390): Mistic mutant sequence
  misc_feature (391)..(435): LINK sequence
  misc_feature (436)..(2883): GABABR1 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaaggctcctctggcagcagcggttcctcactagttccgcgtgtttcctcccactccccccatctcccgcggcctcactcgcgggtccccccgcacccatcctcagaacggcgcgcagtgtacatcggggcactgtttcccatgagcgggggctggccagggggccaggccagccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtga

SEQ ID NO: 108 - protein, 960 aa, Artificial Sequence
  MISTIC fusion protein / protein domain pMistic(EK)-LINK-GABABR1
  MISC_FEATURE (1)..(20): octa-his sequence
  MISC_FEATURE (21)..(130): Mistic mutant sequence
  MISC_FEATURE (131)..(145): LINK sequence
  MISC_FEATURE (146)..(960): GABABR1 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSDDDDKEGSSGSSGSSLVPRGSSHSPHLPRPHSRVPPHPSSERRAVYIGALFPMSGGWPGGQASQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 109 - DNA, 1692 bp, Artificial Sequence
  MISTIC fusion protein / protein domain pMistic(EK)-LINK-VIPR2
  misc_feature (1)..(60): octa-his sequence
  misc_feature (61)..(390): Mistic mutant sequence
  misc_feature (391)..(435): LINK sequence
  misc_feature (436)..(1692): VIPR2 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgacgacgacgacaaagaaggctcctctggcagcagcggttcctcactagttccgcgtgtttccattcacccagaatgccgatttcatctggaaatacaggaggaagaaacaaaatgtgcagagcttctgaggtctcaaacagaaaaacacaaagcctgcagtggcgtctgggacaacatcacgtgctggcggcctgccaatgtgggagagaccgtcacggtgccctgcccaaaagtcttcagcaatttttacagcaaagcaggaaacataagcaaaaactgtacgagtgacggatggtcagagacgttcccagatttcgtcgatgcctgtggctacagcgacccggaggatgagagcaagatcacgttttatattctggtgaaggccatttataccctgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctag

SEQ ID NO: 110 - protein, 563 aa, Artificial Sequence
  MISTIC fusion protein / protein domain pMistic(EK)-LINK-VIPR2
  MISC_FEATURE (1)..(20): octa-his sequence
  MISC_FEATURE (21)..(130): Mistic mutant sequence
  MISC_FEATURE (131)..(145): LINK sequence
  MISC_FEATURE (146)..(563): VIPR2 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSDDDDKEGSSGSSGSSLVPRGSIHPECRFHLEIQEEETKCAELLRSQTEKHKACSGVWDNITCWRPANVGETVTVPCPKVFSNFYSKAGNISKNCTSDGWSETFPDFVDACGYSDPEDESKITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 111 - DNA, 492 bp, Artificial Sequence
  MISTIC fusion protein / protein domain pMis
  misc_feature (1)..(60): octa-his sequence
  misc_feature (61)..(390): Mistic sequence
  misc_feature (391)..(492): Linker sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaggttctggttctggccatatgcaccatcatcatcatcattcttctggtggatcatcaacaagtttgtacaaaaaagcaggctctctggtgccacgcggttct

SEQ ID NO: 112 - protein, 164 aa, Artificial Sequence
  MISTIC fusion protein / protein domain pMis
  MISC_FEATURE (1)..(20): octa-his sequence
  MISC_FEATURE (21)..(130): Mistic sequence
  MISC_FEATURE (131)..(164): Linker sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKEGSGSGHMHHHHHHSSGGSSTSLYKKAGSLVPRGS

SEQ ID NO: 113 - DNA, 654 bp, Artificial Sequence
  MISTIC fusion protein / protein domain pMisT
  misc_feature (1)..(60): octa-his sequence
  misc_feature (61)..(390): Mistic sequence
  misc_feature (391)..(552): transmembrane sequence
  misc_feature (553)..(654): Linker sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaggttctggttctggccatatgcaccatcatcatcatcattcttctggtggatcatcaacaagtttgtacaaaaaagcaggctctctggtgccacgcggttct

SEQ ID NO: 114 - protein, 218 aa, Artificial Sequence
  MISTIC fusion protein / protein domain pMisT
  MISC_FEATURE (1)..(20): octa-his sequence
  MISC_FEATURE (21)..(130): Mistic sequence
  MISC_FEATURE (131)..(184): transmembrane sequence
  MISC_FEATURE (185)..(218): Linker sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKELVPRGSMSAPDSWRERLYIVIFQTDTRDGRRFDSALLLVILASLLVVMIDSIDEGSGSGHMHHHHHHSSGGSSTSLYKKAGSLVPRGS

SEQ ID NO: 115 - DNA, 2260 bp, Artificial Sequence
  MISTIC fusion protein / protein domain pMis-Alk2
  misc_feature (1)..(492): pMis sequence
  misc_feature (493)..(2260): Alk2 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaggttctggttctggccatatgcaccatcatcatcatcattcttctggtggatcatcaacaagtttgtacaaaaaagcaggctctctggtgccacgcggttctgtaaaacgacggccagtcttaagctcgggccccaaataatgattttattttgactgatagtgacctgttcgttgcaacacattgatgagcaatgcttttttataatgccaactttgtacaaaaaagcaggctctctggtgccacgcggttctggttctgatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggtttatgagcagggaaagatgacctgtaagaccccgccgtcccctggccaagctgtggagtgctgccaaggggactggtgtaacaggaacatcacggcccagctgcccactaaaggaaaatccttccctggaacacagaatttccacttggaggttggcctcattattctctctgtagtgttcgcagtatgtcttttagcctgcctgctgggagttgctctccgaaaatttaaaaggcgcaaccaagaacgcctcaatccccgagacgtggagtatggcactatcgaagggctcatcaccaccaatgttggagacagcactttagcagatttattggatcattcgtgtacatcaggaagtggctctggtcttccttttctggtacaaagaacagtggctcgccagattacactgttggagtgtgtcgggaaaggcaggtatggtgaggtgtggaggggcagctggcaaggggaaaatgttgccgtgaagatcttctcctcccgtgatgagaagtcatggttcagggaaacggaattgtacaacactgtgatgctgaggcatgaaaatatcttaggtttcattgcttcagacatgacatcaagacactccagtacccagctgtggttaattacacattatcatgaaatgggatcgttgtacgactatcttcagcttactactctggatacagttagctgccttcgaatagtgctgtccatagctagtggtcttgcacatttgcacatagagatatttgggacccaagggaaaccagccattgcccatcgagatttaaagagcaaaaatattctggttaagaagaatggacagtgttgcatagcagatttgggcctggcagtcatgcattcccagagcaccaatcagcttgatgtggggaacaatccccgtgtgggcaccaagcgctacatggcccccgaagttctagatgaaaccatccaggtggattgtttcgattcttataaaagggtcgatatttgggcctttggacttgttttgtgggaagtggccaggcggatggtgagcaatggtatagtggaggattacaagccaccgttctacgatgtggttcccaatgacccaagttttgaagatatgaggaaggtagtctgtgtggatcaacaaaggccaaacatacccaacagatggttctcagacccgacattaacctctctggccaagctaatgaaagaatgctggtatcaaaatccatccgcaagactcacagcactgcgtatcaaaaagactttgaccaaaattgataattccctcgacaaattgaaaactgactgttgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatag

SEQ ID NO: 116 - protein, 655 aa, Artificial Sequence
  MISTIC fusion protein / protein domain pMis-Alk2
  MISC_FEATURE (1)..(164): pMis sequence
  MISC_FEATURE (165)..(655): Alk2 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKEGSGSGHMHHHHHHSSGGSSTSLYKKAGSLVPRGSGSGSDEKPKVNPKLYMCVCEGLSCGNEDHCEGQQCFSSLSINDGFHVYQKGCFQVYEQGKMTCKTPPSPGQAVECCQGDWCNRNITAQLPTKGKSFPGTQNFHLEVGLIILSVVFAVCLLACLLGVALRKFKRRNQERLNPRDVEYGTIEGLITTNVGDSTLADLLDHSCTSGSGSGLPFLVQRTVARQITLLECVGKGRYGEVWRGSWQGENVAVKIFSSRDEKSWFRETELYNTVMLRHENILGFIASDMTSRHSSTQLWLITHYHEMGSLYDYLQLTTLDTVSCLRIVLSIASGLAHLHIEIFGTQGKPAIAHRDLKSKNILVKKNGQCCIADLGLAVMHSQSTNQLDVGNNPRVGTKRYMAPEVLDETIQVDCFDSYKRVDIWAFGLVLWEVARRMVSNGIVEDYKPPFYDVVPNDPSFEDMRKVVCVDQQRPNIPNRWFSDPTLTSLAKLMKECWYQNPSARLTALRIKKTLTKIDNSLDKLKTDC

SEQ ID NO: 117 - DNA, 2422 bp, Artificial Sequence
  MISTIC fusion protein / protein domain pMisT-Alk2
  misc_feature (1)..(654): pMisT sequence
  misc_feature (655)..(2422): Alk2 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaggttctggttctggccatatgcaccatcatcatcatcattcttctggtggatcatcaacaagtttgtacaaaaaagcaggctctctggtgccacgcggttctgtaaaacgacggccagtcttaagctcgggccccaaataatgattttattttgactgatagtgacctgttcgttgcaacacattgatgagcaatgcttttttataatgccaactttgtacaaaaaagcaggctctctggtgccacgcggttctggttctgatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggtttatgagcagggaaagatgacctgtaagaccccgccgtcccctggccaagctgtggagtgctgccaaggggactggtgtaacaggaacatcacggcccagctgcccactaaaggaaaatccttccctggaacacagaatttccacttggaggttggcctcattattctctctgtagtgttcgcagtatgtcttttagcctgcctgctgggagttgctctccgaaaatttaaaaggcgcaaccaagaacgcctcaatccccgagacgtggagtatggcactatcgaagggctcatcaccaccaatgttggagacagcactttagcagatttattggatcattcgtgtacatcaggaagtggctctggtcttccttttctggtacaaagaacagtggctcgccagattacactgttggagtgtgtcgggaaaggcaggtatggtgaggtgtggaggggcagctggcaaggggaaaatgttgccgtgaagatcttctcctcccgtgatgagaagtcatggttcagggaaacggaattgtacaacactgtgatgctgaggcatgaaaatatcttaggtttcattgcttcagacatgacatcaagacactccagtacccagctgtggttaattacacattatcatgaaatgggatcgttgtacgactatcttcagcttactactctggatacagttagctgccttcgaatagtgctgtccatagctagtggtcttgcacatttgcacatagagatatttgggacccaagggaaaccagccattgcccatcgagatttaaagagcaaaaatattctggttaagaagaatggacagtgttgcatagcagatttgggcctggcagtcatgcattcccagagcaccaatcagcttgatgtggggaacaatccccgtgtgggcaccaagcgctacatggcccccgaagttctagatgaaaccatccaggtggattgtttcgattcttataaaagggtcgatatttgggcctttggacttgttttgtgggaagtggccaggcggatggtgagcaatggtatagtggaggattacaagccaccgttctacgatgtggttcccaatgacccaagttttgaagatatgaggaaggtagtctgtgtggatcaacaaaggccaaacatacccaacagatggttctcagacccgacattaacctctctggccaagctaatgaaagaatgctggtatcaaaatccatccgcaagactcacagcactgcgtatcaaaaagactttgaccaaaattgataattccctcgacaaattgaaaactgactgttgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatag

SEQ ID NO: 118 - protein, 709 aa, Artificial Sequence
  MISTIC fusion protein / protein domain pMisT-Alk2
  MISC_FEATURE (1)..(218): pMisT sequence
  MISC_FEATURE (219)..(709): Alk2 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKELVPRGSMSAPDSWRERLYIVIFQTDTRDGRRFDSALLLVILASLLVVMIDSIDEGSGSGHMHHHHHHSSGGSSTSLYKKAGSLVPRGSGSGSDEKPKVNPKLYMCVCEGLSCGNEDHCEGQQCFSSLSINDGFHVYQKGCFQVYEQGKMTCKTPPSPGQAVECCQGDWCNRNITAQLPTKGKSFPGTQNFHLEVGLIILSVVFAVCLLACLLGVALRKFKRRNQERLNPRDVEYGTIEGLITTNVGDSTLADLLDHSCTSGSGSGLPFLVQRTVARQITLLECVGKGRYGEVWRGSWQGENVAVKIFSSRDEKSWFRETELYNTVMLRHENILGFIASDMTSRHSSTQLWLITHYHEMGSLYDYLQLTTLDTVSCLRIVLSIASGLAHLHIEIFGTQGKPAIAHRDLKSKNILVKKNGQCCIADLGLAVMHSQSTNQLDVGNNPRVGTKRYMAPEVLDETIQVDCFDSYKRVDIWAFGLVLWEVARRMVSNGIVEDYKPPFYDVVPNDPSFEDMRKVVCVDQQRPNIPNRWFSDPTLTSLAKLMKECWYQNPSARLTALRIKKTLTKIDNSLDKLKTDC

SEQ ID NO: 119 - DNA, 2326 bp, Artificial Sequence
  MISTIC fusion protein / protein domain pMis-Alk3
  misc_feature (1)..(492): pMis sequence
  misc_feature (493)..(2326): Alk3 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaggttctggttctggccatatgcaccatcatcatcatcattcttctggtggatcatcaacaagtttgtacaaaaaagcaggctctctggtgccacgcggttctgtaaaacgacggccagtcttaagctcgggccccaaataatgattttattttgactgatagtgacctgttcgttgcaacacattgatgagcaatgcttttttataatgccaactttgtacaaaaaagcaggctctctggtgccacgcggttctggttctcagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcataactaatggacattgctttgccatcatagaagaagatgaccagggagaaaccacattagcttcagggtgtatgaaatatgaaggatctgattttcagtgcaaagattctccaaaagcccagctacgccggacaatagaatgttgtcggaccaatttatgtaaccagtatttgcaacccacactgccccctgttgtcataggtccgttttttgatggcagcattcgatggctggttttgctcatttctatggctgtctgcataattgctatgatcatcttctccagctgcttttgttacaaacattattgcaagagcatctcaagcagacgtcgttacaatcgtgatttggaacaggatgaagcatttattccagttggagaatcactaaaagaccttattgaccagtcacaaagttctggtagtgggtctggactacctttattggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcctccagactcacagcattgagaattaagaagacgcttgccaagatggttgaatcccaagatgtaaaaatctgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatag

SEQ ID NO: 120 - protein, 677 aa, Artificial Sequence
  MISTIC fusion protein / protein domain pMis-Alk3
  MISC_FEATURE (1)..(164): pMis sequence
  MISC_FEATURE (165)..(677): Alk3 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKEGSGSGHMHHHHHHSSGGSSTSLYKKAGSLVPRGSGSGSQNLDSMLHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIRWLVLLISMAVCIIAMIIFSSCFCYKHYCKSISSRRRYNRDLEQDEAFIPVGESLKDLIDQSQSSGSGSGLPLLVQRTIAKQIQMVRQVGKGRYGEVWMGKWRGEKVAVKVFFTTEEASWFRETEIYQTVLMRHENILGFIAADIKGTGSWTQLYLITDYHENGSLYDFLKCATLDTRALLKLAYSAACGLCHLHTEIYGTQGKPAIAHRDLKSKNILIKKNGSCCIADLGLAVKFNSDTNEVDVPLNTRVGTKRYMAPEVLDESLNKNHFQPYIMADIYSFGLIIWEMARRCITGGIVEEYQLPYYNMVPSDPSYEDMREVVCVKRLRPIVSNRWNSDECLRAVLKLMSECWAHNPASRLTALRIKKTLAKMVESQDVKI

SEQ ID NO: 121 - DNA, 2488 bp, Artificial Sequence
  MISTIC fusion protein / protein domain pMisT-Alk3
  misc_feature (1)..(654): pMisT sequence
  misc_feature (655)..(2488): Alk3 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaggttctggttctggccatatgcaccatcatcatcatcattcttctggtggatcatcaacaagtttgtacaaaaaagcaggctctctggtgccacgcggttctgtaaaacgacggccagtcttaagctcgggccccaaataatgattttattttgactgatagtgacctgttcgttgcaacacattgatgagcaatgcttttttataatgccaactttgtacaaaaaagcaggctctctggtgccacgcggttctggttctcagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcataactaatggacattgctttgccatcatagaagaagatgaccagggagaaaccacattagcttcagggtgtatgaaatatgaaggatctgattttcagtgcaaagattctccaaaagcccagctacgccggacaatagaatgttgtcggaccaatttatgtaaccagtatttgcaacccacactgccccctgttgtcataggtccgttttttgatggcagcattcgatggctggttttgctcatttctatggctgtctgcataattgctatgatcatcttctccagctgcttttgttacaaacattattgcaagagcatctcaagcagacgtcgttacaatcgtgatttggaacaggatgaagcatttattccagttggagaatcactaaaagaccttattgaccagtcacaaagttctggtagtgggtctggactacctttattggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcctccagactcacagcattgagaattaagaagacgcttgccaagatggttgaatcccaagatgtaaaaatctgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatag

SEQ ID NO: 122 - protein, 731 aa, Artificial Sequence
  MISTIC fusion protein / protein domain pMisT-Alk3
  MISC_FEATURE (1)..(218): pMisT sequence
  MISC_FEATURE (219)..(731): Alk3 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKELVPRGSMSAPDSWRERLYIVIFQTDTRDGRRFDSALLLVILASLLVVMIDSIDEGSGSGHMHHHHHHSSGGSSTSLYKKAGSLVPRGSGSGSQNLDSMLHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIRWLVLLISMAVCIIAMIIFSSCFCYKHYCKSISSRRRYNRDLEQDEAFIPVGESLKDLIDQSQSSGSGSGLPLLVQRTIAKQIQMVRQVGKGRYGEVWMGKWRGEKVAVKVFFTTEEASWFRETEIYQTVLMRHENILGFIAADIKGTGSWTQLYLITDYHENGSLYDFLKCATLDTRALLKLAYSAACGLCHLHTEIYGTQGKPAIAHRDLKSKNILIKKNGSCCIADLGLAVKFNSDTNEVDVPLNTRVGTKRYMAPEVLDESLNKNHFQPYIMADIYSFGLIIWEMARRCITGGIVEEYQLPYYNMVPSDPSYEDMREVVCVKRLRPIVSNRWNSDECLRAVLKLMSECWAHNPASRLTALRIKKTLAKMVESQDVKI

SEQ ID NO: 123 - DNA, 2206 bp, Artificial Sequence
  MISTIC fusion protein / protein domain pMis-Alk5
  misc_feature (1)..(492): pMis sequence
  misc_feature (493)..(2206): Alk5 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaggttctggttctggccatatgcaccatcatcatcatcattcttctggtggatcatcaacaagtttgtacaaaaaagcaggctctctggtgccacgcggttctgtaaaacgacggccagtcttaagctcgggccccaaataatgattttattttgactgatagtgacctgttcgttgcaacacattgatgagcaatgcttttttataatgccaactttgtacaaaaaagcaggctctctggtgccacgcggttctggttctcagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatag

SEQ ID NO: 124 - protein, 637 aa, Artificial Sequence
  MISTIC fusion protein / protein domain pMis-Alk5
  MISC_FEATURE (1)..(164): pMis sequence
  MISC_FEATURE (165)..(637): Alk5 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKEGSGSGHMHHHHHHSSGGSSTSLYKKAGSLVPRGSGSGSQCFCHLCTKDNFTCVTDGLCFVSVTETTDKVIHNSMCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 125 - DNA, 2368 bp, Artificial Sequence
  MISTIC fusion protein / protein domain pMisT-Alk5
  misc_feature (1)..(654): pMisT sequence
  misc_feature (655)..(2368): Alk5 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaggttctggttctggccatatgcaccatcatcatcatcattcttctggtggatcatcaacaagtttgtacaaaaaagcaggctctctggtgccacgcggttctgtaaaacgacggccagtcttaagctcgggccccaaataatgattttattttgactgatagtgacctgttcgttgcaacacattgatgagcaatgcttttttataatgccaactttgtacaaaaaagcaggctctctggtgccacgcggttctggttctcagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatag

SEQ ID NO: 126 - protein, 691 aa, Artificial Sequence
  MISTIC fusion protein / protein domain pMisT-Alk5
  MISC_FEATURE (1)..(218): pMisT sequence
  MISC_FEATURE (219)..(691): Alk5 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKELVPRGSMSAPDSWRERLYIVIFQTDTRDGRRFDSALLLVILASLLVVMIDSIDEGSGSGHMHHHHHHSSGGSSTSLYKKAGSLVPRGSGSGSQCFCHLCTKDNFTCVTDGLCFVSVTETTDKVIHNSMCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 127 - DNA, 2266 bp, Artificial Sequence
  MISTIC fusion protein / protein domain pMis-Alk6
  misc_feature (1)..(492): pMis sequence
  misc_feature (493)..(2266): Alk6 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaggttctggttctggccatatgcaccatcatcatcatcattcttctggtggatcatcaacaagtttgtacaaaaaagcaggctctctggtgccacgcggttctgtaaaacgacggccagtcttaagctcgggccccaaataatgattttattttgactgatagtgacctgttcgttgcaacacattgatgagcaatgcttttttataatgccaactttgtacaaaaaagcaggctctctggtgccacgcggttctggttctaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatag

SEQ ID NO: 128 - protein, 657 aa, Artificial Sequence
  MISTIC fusion protein / protein domain pMis-Alk6
  MISC_FEATURE (1)..(164): pMis sequence
  MISC_FEATURE (165)..(657): Alk5 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKEGSGSGHMHHHHHHSSGGSSTSLYKKAGSLVPRGSGSGSKKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHHRALLISVTVCSLLLVLIILFCYFRYKRQETRPRYSIGLEQDETYIPPGESLRDLIEQSQSSGSGSGLPLLVQRTIAKQIQMVKQIGKGRYGEVWMGKWRGEKVAVKVFFTTEEASWFRETEIYQTVLMRHENILGFIAADIKGTGSWTQLYLITDYHENGSLYDYLKSTTLDAKSMLKLAYSSVSGLCHLHTEIFSTQGKPAIAHRDLKSKNILVKKNGTCCIADLGLAVKFISDTNEVDIPPNTRVGTKRYMPPEVLDESLNRNHFQSYIMADMYSFGLILWEVARRCVSGGIVEEYQLPYHDLVPSDPSYEDMREIVCIKKLRPSFPNRWSSDECLRQMGKLMTECWAHNPASRLTALRVKKTLAKMSESQDIKL

SEQ ID NO: 129 - DNA, 2428 bp, Artificial Sequence
  MISTIC fusion protein / protein domain pMisT-Alk6
  misc_feature (1)..(654): pMisT sequence
  misc_feature (655)..(2428): Alk6 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaggttctggttctggccatatgcaccatcatcatcatcattcttctggtggatcatcaacaagtttgtacaaaaaagcaggctctctggtgccacgcggttctgtaaaacgacggccagtcttaagctcgggccccaaataatgattttattttgactgatagtgacctgttcgttgcaacacattgatgagcaatgcttttttataatgccaactttgtacaaaaaagcaggctctctggtgccacgcggttctggttctaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatag

SEQ ID NO: 130 - protein, 711 aa, Artificial Sequence [sequence omitted]

SEQ ID NO: 131 - DNA, 2281 bp, Artificial Sequence
  MISTIC fusion protein / protein domain pMis-ActRII
  misc_feature (1)..(492): pMis sequence
  misc_feature (493)..(2281): ActRII sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaggttctggttctggccatatgcaccatcatcatcatcattcttctggtggatcatcaacaagtttgtacaaaaaagcaggctctctggtgccacgcggttctgtaaaacgacggccagtcttaagctcgggccccaaataatgattttattttgactgatagtgacctgttcgttgcaacacattgatgagcaatgcttttttataatgccaactttgtacaaaaaagcaggctctctggtgccacgcggttctggttctgctatacttggcagatcagaaactcaggagtgtcttttctttaatgctaattgggaaagagacagaaccaaccagactggtgttgaaccttgctatggtgataaagataaacggcgacattgttttgctacctggaagaatatttctggtttcattgaaatagtgaagcaaggttgttggctggatgatatcaactgctatgacaggactgattgtatagaaaaaaaagacagccctgaagtgtacttttgttgctgtgagggcaatatgtgtaatgaaaagttctcttattttccggagatggaagtcacacagcccacttcaaatcctgttacaccgaagccaccctattacaacattctgctgtattccttggtaccactaatgttaattgcaggaattgtcatttgtgcattttgggtgtacagacatcacaagatggcctaccctcctgtacttgttcctactcaagacccaggaccacccccaccttccccattactagggttgaagccattgcagctgttagaagtgaaagcaaggggaagatttggttgtgtctggaaagcccagttgctcaatgaatatgtggctgtcaaaatatttccaatacaggacaaacagtcctggcagaatgaatatgaagtctatagtctacctggaatgaagcatgagaacatactacagttcattggtgcagagaaaagaggcaccagtgtggatgtggacctgtggctaatcacagcatttcatgaaaagggctcactgtcagactttcttaaggctaatgtggtctcttggaatgaactttgtcatattgcagaaaccatggctagaggattggcatatttacatgaggatatacctggcttaaaagatggccacaagcctgcaatctctcacagggacatcaaaagtaaaaatgtgctgttgaaaaacaatctgacagcttgcattgctgactttgggttggccttaaagttcgaggctggcaagtctgcaggtgacacccatgggcaggttggtacccggaggtatatggctccagaggtgttggagggtgctataaacttacaaagggacgcatttctgaggatagatatgtacgccatgggattagtcctatgggaattggcttctcgttgcactgctgcagatggacccgtagatgagtacatgttaccatttgaggaagaaattggccagcatccatctcttgaagatatgcaggaagttgttgtgcataaaaaaaagaggcctgttttaagagattattggcagaaacatgcaggaatggcaatgctctgtgaaacgatagaagaatgttgggatcatgatgcagaagccaggttatcagctggatgtgtaggtgaaagaattactcagatgcaaagactaacaaatatcattactacagaggacattgtaacagtggtcacaatggtgacaaatgttgactttcctcccaaagaatctagtctatgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatag

SEQ ID NO: 132 - protein, 662 aa, Artificial Sequence
  MISTIC fusion protein / protein domain pMis-ActRII
  MISC_FEATURE (1)..(164): pMis sequence
  MISC_FEATURE (165)..(662): ActRII sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKEGSGSGHMHHHHHHSSGGSSTSLYKKAGSLVPRGSGSGSAILGRSETQECLFFNANWERDRTNQTGVEPCYGDKDKRRHCFATWKNISGFIEIVKQGCWLDDINCYDRTDCIEKKDSPEVYFCCCEGNMCNEKFSYFPEMEVTQPTSNPVTPKPPYYNILLYSLVPLMLIAGIVICAFWVYRHHKMAYPPVLVPTQDPGPPPPSPLLGLKPLQLLEVKARGRFGCVWKAQLLNEYVAVKIFPIQDKQSWQNEYEVYSLPGMKHENILQFIGAEKRGTSVDVDLWLITAFHEKGSLSDFLKANVVSWNELCHIAETMARGLAYLHEDIPGLKDGHKPAISHRDIKSKNVLLKNNLTACIADFGLALKFEAGKSAGDTHGQVGTRRYMAPEVLEGAINLQRDAFLRIDMYAMGLVLWELASRCTAADGPVDEYMLPFEEEIGQHPSLEDMQEVVVHKKKRPVLRDYWQKHAGMAMLCETIEECWDHDAEARLSAGCVGERITQMQRLTNIITTEDIVTVVTMVTNVDFPPKESSL

SEQ ID NO: 133 - DNA, 2443 bp, Artificial Sequence
  MISTIC fusion protein / protein domain pMisT-ActRII
  misc_feature (1)..(654): pMisT sequence
  misc_feature (655)..(2443): ActRII sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaggttctggttctggccatatgcaccatcatcatcatcattcttctggtggatcatcaacaagtttgtacaaaaaagcaggctctctggtgccacgcggttctgtaaaacgacggccagtcttaagctcgggccccaaataatgattttattttgactgatagtgacctgttcgttgcaacacattgatgagcaatgcttttttataatgccaactttgtacaaaaaagcaggctctctggtgccacgcggttctggttctgctatacttggcagatcagaaactcaggagtgtcttttctttaatgctaattgggaaagagacagaaccaaccagactggtgttgaaccttgctatggtgataaagataaacggcgacattgttttgctacctggaagaatatttctggtttcattgaaatagtgaagcaaggttgttggctggatgatatcaactgctatgacaggactgattgtatagaaaaaaaagacagccctgaagtgtacttttgttgctgtgagggcaatatgtgtaatgaaaagttctcttattttccggagatggaagtcacacagcccacttcaaatcctgttacaccgaagccaccctattacaacattctgctgtattccttggtaccactaatgttaattgcaggaattgtcatttgtgcattttgggtgtacagacatcacaagatggcctaccctcctgtacttgttcctactcaagacccaggaccacccccaccttccccattactagggttgaagccattgcagctgttagaagtgaaagcaaggggaagatttggttgtgtctggaaagcccagttgctcaatgaatatgtggctgtcaaaatatttccaatacaggacaaacagtcctggcagaatgaatatgaagtctatagtctacctggaatgaagcatgagaacatactacagttcattggtgcagagaaaagaggcaccagtgtggatgtggacctgtggctaatcacagcatttcatgaaaagggctcactgtcagactttcttaaggctaatgtggtctcttggaatgaactttgtcatattgcagaaaccatggctagaggattggcatatttacatgaggatatacctggcttaaaagatggccacaagcctgcaatctctcacagggacatcaaaagtaaaaatgtgctgttgaaaaacaatctgacagcttgcattgctgactttgggttggccttaaagttcgaggctggcaagtctgcaggtgacacccatgggcaggttggtacccggaggtatatggctccagaggtgttggagggtgctataaacttacaaagggacgcatttctgaggatagatatgtacgccatgggattagtcctatgggaattggcttctcgttgcactgctgcagatggacccgtagatgagtacatgttaccatttgaggaagaaattggccagcatccatctcttgaagatatgcaggaagttgttgtgcataaaaaaaagaggcctgttttaagagattattggcagaaacatgcaggaatggcaatgctctgtgaaacgatagaagaatgttgggatcatgatgcagaagccaggttatcagctggatgtgtaggtgaaagaattactcagatgcaaagactaacaaatatcattactacagaggacattgtaacagtggtcacaatggtgacaaatgttgactttcctcccaaagaatctagtctatgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatag

SEQ ID NO: 134 - protein, 716 aa, Artificial Sequence
  MISTIC fusion protein / protein domain pMisT-ActRII
  MISC_FEATURE (1)..(218): pMisT sequence
  MISC_FEATURE (219)..(716): ActRII sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKELVPRGSMSAPDSWRERLYIVIFQTDTRDGRRFDSALLLVILASLLVVMIDSIDEGSGSGHMHHHHHHSSGGSSTSLYKKAGSLVPRGSGSGSAILGRSETQECLFFNANWERDRTNQTGVEPCYGDKDKRRHCFATWKNISGFIEIVKQGCWLDDINCYDRTDCIEKKDSPEVYFCCCEGNMCNEKFSYFPEMEVTQPTSNPVTPKPPYYNILLYSLVPLMLIAGIVICAFWVYRHHKMAYPPVLVPTQDPGPPPPSPLLGLKPLQLLEVKARGRFGCVWKAQLLNEYVAVKIFPIQDKQSWQNEYEVYSLPGMKHENILQFIGAEKRGTSVDVDLWLITAFHEKGSLSDFLKANVVSWNELCHIAETMARGLAYLHEDIPGLKDGHKPAISHRDIKSKNVLLKNNLTACIADFGLALKFEAGKSAGDTHGQVGTRRYMAPEVLEGAINLQRDAFLRIDMYAMGLVLWELASRCTAADGPVDEYMLPFEEEIGQHPSLEDMQEVVVHKKKRPVLRDYWQKHAGMAMLCETIEECWDHDAEARLSAGCVGERITQMQRLTNIITTEDIVTVVTMVTNVDFPPKESSL

SEQ ID NO: 135 - DNA, 2344 bp, Artificial Sequence
  MISTIC fusion protein / protein domain pMis-ActRIIb
  misc_feature (1)..(492): pMis sequence
  misc_feature (493)..(2344): ActRIIb sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaggttctggttctggccatatgcaccatcatcatcatcattcttctggtggatcatcaacaagtttgtacaaaaaagcaggctctctggtgccacgcggttctgtaaaacgacggccagtcttaagctcgggccccaaataatgattttattttgactgatagtgacctgttcgttgcaacacattgatgagcaatgcttttttataatgccaactttgtacaaaaaagcaggctctctggtgccacgcggttctggttctggggaggctgagactcgggagtgcatctactacaacgccaactgggagctggagcgcaccaaccagagcggcctggagcgctgcgagggggaacaggacaagcggctgcactgctacgcctcgtggcgcaacagctcgggcaccatcgagctggtgaagaagggctgctggctagatgacttcaattgctacgacaggcaggagtgtgtggccaccgaggagaacccccaggtgtacttctgctgctgcgaaggcaacttctgcaacgagcgcttcacccacttgccggagcctgggggcccagaagtcacgtacgagccacccccgacagcccccaccctgctcacggtgctggcctactcgctgctgcccattggaggcctctctctcatcgtcctgctggccttctggatgtatcgtcatcggaaacctccctacggccatgtggacatccatgaggtgagacagtgccagcgttgggcagggagaagggacggctgtgcggactcctttaagcccttgcctttccaggacccggggcctccgcccccatcccctctggtgggcctgaagccactacagctgctggagatcaaggctcggggccgctttggctgcgtttggaaggctcagctcatgaacgactttgtggctgtgaagatcttcccacttcaggacaagcagtcgtggcagagtgaacgggaaatcttcagcacacccggcatgaagcacgaaaacttgttgcagttcattgctgccgagaaacgaggctccaacctggaggtggagctgtggctcatcacagccttccacgacaagggctccctcacggattacctcaaggggaacatcatcacgtggaacgaactgtgccacgtggcggagacgatgtcacgaggcctctcatacctgcatgaggatgtgccgtggtgtcgtggtgagggccacaagccttctattgcccacagggacttcaaaagcaagaatgtactgctgaagagcgacctcaccgcggtgctggctgacttcggcctggctgttcggtttgagccagggaagcctcctggggatacccatggacaggttggcaccagacggtacatggcccctgaggtgctggaaggagccatcaacttccagagagacgccttcctgcgtatcgacatgtacgccatgggcctggtgctgtgggagctcgtctctcggtgcaaggctgcagacgggcctgtcgatgagtacatgctgcccttcgaggaggagattggccagcacccttcgctggaggagcttcaggaggtggttgtccacaagaagatgaggcccacgattaaggatcactggctgaaacacccgggcctggcccagctctgcgtgaccatcgaggagtgctgggaccatgatgcagaggctcgcctttctgcaggctgtgtagaagagcgggtatccctgatcaggaggtcggtcaacggcactacctcggactgtctcgtctctctggtgacctccgtcaccaatgtggacctgctccctaaagagtccagcatctgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatag

SEQ ID NO: 136 - protein, 683 aa, Artificial Sequence
  MISTIC fusion protein / protein domain pMis-ActRIIb
  MISC_FEATURE (1)..(164): pMis sequence
  MISC_FEATURE (165)..(683): ActRIIb sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKEGSGSGHMHHHHHHSSGGSSTSLYKKAGSLVPRGSGSGSGEAETRECIYYNANWELERTNQSGLERCEGEQDKRLHCYASWRNSSGTIELVKKGCWLDDFNCYDRQECVATEENPQVYFCCCEGNFCNERFTHLPEPGGPEVTYEPPPTAPTLLTVLAYSLLPIGGLSLIVLLAFWMYRHRKPPYGHVDIHEVRQCQRWAGRRDGCADSFKPLPFQDPGPPPPSPLVGLKPLQLLEIKARGRFGCVWKAQLMNDFVAVKIFPLQDKQSWQSEREIFSTPGMKHENLLQFIAAEKRGSNLEVELWLITAFHDKGSLTDYLKGNIITWNELCHVAETMSRGLSYLHEDVPWCRGEGHKPSIAHRDFKSKNVLLKSDLTAVLADFGLAVRFEPGKPPGDTHGQVGTRRYMAPEVLEGAINFQRDAFLRIDMYAMGLVLWELVSRCKAADGPVDEYMLPFEEEIGQHPSLEELQEVVVHKKMRPTIKDHWLKHPGLAQLCVTIEECWDHDAEARLSAGCVEERVSLIRRSVNGTTSDCLVSLVTSVTNVDLLPKESSI

SEQ ID NO: 137 - DNA, 2506 bp, Artificial Sequence
  MISTIC fusion protein / protein domain pMisT-ActRIIb
  misc_feature (1)..(654): pMisT sequence
  misc_feature (655)..(2506): ActRIIb sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaggttctggttctggccatatgcaccatcatcatcatcattcttctggtggatcatcaacaagtttgtacaaaaaagcaggctctctggtgccacgcggttctgtaaaacgacggccagtcttaagctcgggccccaaataatgattttattttgactgatagtgacctgttcgttgcaacacattgatgagcaatgcttttttataatgccaactttgtacaaaaaagcaggctctctggtgccacgcggttctggttctggggaggctgagactcgggagtgcatctactacaacgccaactgggagctggagcgcaccaaccagagcggcctggagcgctgcgagggggaacaggacaagcggctgcactgctacgcctcgtggcgcaacagctcgggcaccatcgagctggtgaagaagggctgctggctagatgacttcaattgctacgacaggcaggagtgtgtggccaccgaggagaacccccaggtgtacttctgctgctgcgaaggcaacttctgcaacgagcgcttcacccacttgccggagcctgggggcccagaagtcacgtacgagccacccccgacagcccccaccctgctcacggtgctggcctactcgctgctgcccattggaggcctctctctcatcgtcctgctggccttctggatgtatcgtcatcggaaacctccctacggccatgtggacatccatgaggtgagacagtgccagcgttgggcagggagaagggacggctgtgcggactcctttaagcccttgcctttccaggacccggggcctccgcccccatcccctctggtgggcctgaagccactacagctgctggagatcaaggctcggggccgctttggctgcgtttggaaggctcagctcatgaacgactttgtggctgtgaagatcttcccacttcaggacaagcagtcgtggcagagtgaacgggaaatcttcagcacacccggcatgaagcacgaaaacttgttgcagttcattgctgccgagaaacgaggctccaacctggaggtggagctgtggctcatcacagccttccacgacaagggctccctcacggattacctcaaggggaacatcatcacgtggaacgaactgtgccacgtggcggagacgatgtcacgaggcctctcatacctgcatgaggatgtgccgtggtgtcgtggtgagggccacaagccttctattgcccacagggacttcaaaagcaagaatgtactgctgaagagcgacctcaccgcggtgctggctgacttcggcctggctgttcggtttgagccagggaagcctcctggggatacccatggacaggttggcaccagacggtacatggcccctgaggtgctggaaggagccatcaacttccagagagacgccttcctgcgtatcgacatgtacgccatgggcctggtgctgtgggagctcgtctctcggtgcaaggctgcagacgggcctgtcgatgagtacatgctgcccttcgaggaggagattggccagcacccttcgctggaggagcttcaggaggtggttgtccacaagaagatgaggcccacgattaaggatcactggctgaaacacccgggcctggcccagctctgcgtgaccatcgaggagtgctgggaccatgatgcagaggctcgcctttctgcaggctgtgtagaagagcgggtatccctgatcaggaggtcggtcaacggcactacctcggactgtctcgtctctctggtgacctccgtcaccaatgtggacctgctccctaaagagtccagcatctgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatag

SEQ ID NO: 138 - protein, 737 aa, Artificial Sequence
  MISTIC fusion protein / protein domain pMisT-ActRIIb
  MISC_FEATURE (1)..(218): pMisT sequence
  MISC_FEATURE (219)..(737): ActRIIb sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKELVPRGSMSAPDSWRERLYIVIFQTDTRDGRRFDSALLLVILASLLVVMIDSIDEGSGSGHMHHHHHHSSGGSSTSLYKKAGSLVPRGSGSGSGEAETRECIYYNANWELERTNQSGLERCEGEQDKRLHCYASWRNSSGTIELVKKGCWLDDFNCYDRQECVATEENPQVYFCCCEGNFCNERFTHLPEPGGPEVTYEPPPTAPTLLTVLAYSLLPIGGLSLIVLLAFWMYRHRKPPYGHVDIHEVRQCQRWAGRRDGCADSFKPLPFQDPGPPPPSPLVGLKPLQLLEIKARGRFGCVWKAQLMNDFVAVKIFPLQDKQSWQSEREIFSTPGMKHENLLQFIAAEKRGSNLEVELWLITAFHDKGSLTDYLKGNIITWNELCHVAETMSRGLSYLHEDVPWCRGEGHKPSIAHRDFKSKNVLLKSDLTAVLADFGLAVRFEPGKPPGDTHGQVGTRRYMAPEVLEGAINFQRDAFLRIDMYAMGLVLWELVSRCKAADGPVDEYMLPFEEEIGQHPSLEELQEVVVHKKMRPTIKDHWLKHPGLAQLCVTIEECWDHDAEARLSAGCVEERVSLIRRSVNGTTSDCLVSLVTSVTNVDLLPKESSI

SEQ ID NO: 139 - DNA, 2311 bp, Artificial Sequence
  MISTIC fusion protein / protein domain pMis-BMPRII
  misc_feature (1)..(492): pMis sequence
  misc_feature (493)..(2311): BMPRII sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaggttctggttctggccatatgcaccatcatcatcatcattcttctggtggatcatcaacaagtttgtacaaaaaagcaggctctctggtgccacgcggttctgtaaaacgacggccagtcttaagctcgggccccaaataatgattttattttgactgatagtgacctgttcgttgcaacacattgatgagcaatgcttttttataatgccaactttgtacaaaaaagcaggctctctggtgccacgcggttctggttcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtccacctcattcatttaaccgagatgagacaataatcattgctttggcatcagtctctgtattagctgttttgatagttgccttatgctttggatacagaatgttgacaggagaccgtaaacaaggtcttcacagtatgaacatgatggaggcagcagcatccgaaccctctcttgatctagataatctgaaactgttggagctgattggccgaggtcgatatggagcagtatataaaggctccttggatgagcgtccagttgctgtaaaagtgttttcctttgcaaaccgtcagaattttatcaacgaaaagaacatttacagagtgcctttgatggaacatgacaacattgcccgctttatagttggagatgagagagtcactgcagatggacgcatggaatatttgcttgtgatggagtactatcccaatggatctttatgcaagtatttaagtctccacacaagtgactgggtaagctcttgccgtcttgctcattctgttactagaggactggcttatcttcacacagaattaccacgaggagatcattataaacctgcaatttcccatcgagatttaaacagcagaaatgtcctagtgaaaaatgatggaacctgtgttattagtgactttggactgtccatgaggctgactggaaatagactggtgcgcccaggggaggaagataatgcagccataagcgaggttggcactatcagatatatggcaccagaagtgctagaaggagctgtgaacttgagggactgtgaatcagctttgaaacaagtagacatgtatgctcttggactaatctattgggagatatttatgagatgtacagacctcttcccaggggaatccgtaccagagtaccagatggcttttcagacagaggttggaaaccatcccacttttgaggatatgcaggttctcgtgtctagggaaaaacagagacccaagttcccagaagcctggaaagaaaatagcctggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacgtaggtgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatag

SEQ ID NO: 140 - protein, 672 aa, Artificial Sequence
  MISTIC fusion protein / protein domain pMis-BMPRII
  MISC_FEATURE (1)..(164): pMis sequence
  MISC_FEATURE (165)..(672): BMPRII sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKEGSGSGHMHHHHHHSSGGSSTSLYKKAGSLVPRGSGSGSSQNQERLCAFKDPYQQDLGIGESRISHENGTILCSKGSTCYGLWEKSKGDINLVKQGCWSHIGDPQECHYEECVVTTTPPSIQNGTYRFCCCSTDLCNVNFTENFPPPDTTPLSPPHSFNRDETIIIALASVSVLAVLIVALCFGYRMLTGDRKQGLHSMNMMEAAASEPSLDLDNLKLLELIGRGRYGAVYKGSLDERPVAVKVFSFANRQNFINEKNIYRVPLMEHDNIARFIVGDERVTADGRMEYLLVMEYYPNGSLCKYLSLHTSDWVSSCRLAHSVTRGLAYLHTELPRGDHYKPAISHRDLNSRNVLVKNDGTCVISDFGLSMRLTGNRLVRPGEEDNAAISEVGTIRYMAPEVLEGAVNLRDCESALKQVDMYALGLIYWEIFMRCTDLFPGESVPEYQMAFQTEVGNHPTFEDMQVLVSREKQRPKFPEAWKENSLAVRSLKETIEDCWDQDAEARLTAQCAEERMAELMMIWERNKSVSPTVNPMSTAMQNERR

SEQ ID NO: 141 - DNA, 2473 bp, Artificial Sequence
  MISTIC fusion protein / protein domain pMisT-BMPRII
  misc_feature (1)..(654): pMisT sequence
  misc_feature (655)..(2473): BMPRII sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaggttctggttctggccatatgcaccatcatcatcatcattcttctggtggatcatcaacaagtttgtacaaaaaagcaggctctctggtgccacgcggttctgtaaaacgacggccagtcttaagctcgggccccaaataatgattttattttgactgatagtgacctgttcgttgcaacacattgatgagcaatgcttttttataatgccaactttgtacaaaaaagcaggctctctggtgccacgcggttctggttcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtccacctcattcatttaaccgagatgagacaataatcattgctttggcatcagtctctgtattagctgttttgatagttgccttatgctttggatacagaatgttgacaggagaccgtaaacaaggtcttcacagtatgaacatgatggaggcagcagcatccgaaccctctcttgatctagataatctgaaactgttggagctgattggccgaggtcgatatggagcagtatataaaggctccttggatgagcgtccagttgctgtaaaagtgttttcctttgcaaaccgtcagaattttatcaacgaaaagaacatttacagagtgcctttgatggaacatgacaacattgcccgctttatagttggagatgagagagtcactgcagatggacgcatggaatatttgcttgtgatggagtactatcccaatggatctttatgcaagtatttaagtctccacacaagtgactgggtaagctcttgccgtcttgctcattctgttactagaggactggcttatcttcacacagaattaccacgaggagatcattataaacctgcaatttcccatcgagatttaaacagcagaaatgtcctagtgaaaaatgatggaacctgtgttattagtgactttggactgtccatgaggctgactggaaatagactggtgcgcccaggggaggaagataatgcagccataagcgaggttggcactatcagatatatggcaccagaagtgctagaaggagctgtgaacttgagggactgtgaatcagctttgaaacaagtagacatgtatgctcttggactaatctattgggagatatttatgagatgtacagacctcttcccaggggaatccgtaccagagtaccagatggcttttcagacagaggttggaaaccatcccacttttgaggatatgcaggttctcgtgtctagggaaaaacagagacccaagttcccagaagcctggaaagaaaatagcctggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacgtaggtgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatag

SEQ ID NO: 142 - protein, 726 aa, Artificial Sequence
  MISTIC fusion protein / protein domain pMisT-BMPRII
  MISC_FEATURE (1)..(218): pMisT sequence
  MISC_FEATURE (219)..(726): BMPRII sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKELVPRGSMSAPDSWRERLYIVIFQTDTRDGRRFDSALLLVILASLLVVMIDSIDEGSGSGHMHHHHHHSSGGSSTSLYKKAGSLVPRGSGSGSSQNQERLCAFKDPYQQDLGIGESRISHENGTILCSKGSTCYGLWEKSKGDINLVKQGCWSHIGDPQECHYEECVVTTTPPSIQNGTYRFCCCSTDLCNVNFTENFPPPDTTPLSPPHSFNRDETIIIALASVSVLAVLIVALCFGYRMLTGDRKQGLHSMNMMEAAASEPSLDLDNLKLLELIGRGRYGAVYKGSLDERPVAVKVFSFANRQNFINEKNIYRVPLMEHDNIARFIVGDERVTADGRMEYLLVMEYYPNGSLCKYLSLHTSDWVSSCRLAHSVTRGLAYLHTELPRGDHYKPAISHRDLNSRNVLVKNDGTCVISDFGLSMRLTGNRLVRPGEEDNAAISEVGTIRYMAPEVLEGAVNLRDCESALKQVDMYALGLIYWEIFMRCTDLFPGESVPEYQMAFQTEVGNHPTFEDMQVLVSREKQRPKFPEAWKENSLAVRSLKETIEDCWDQDAEARLTAQCAEERMAELMMIWERNKSVSPTVNPMSTAMQNERR

SEQ ID NO: 143 - DNA, 1975 bp, Artificial Sequence
  MISTIC fusion protein / protein domain pMis-CRFR1
  misc_feature (1)..(492): pMis sequence
  misc_feature (493)..(1975): CRFR1 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaggttctggttctggccatatgcaccatcatcatcatcattcttctggtggatcatcaacaagtttgtacaaaaaagcaggctctctggtgccacgcggttctgtaaaacgacggccagtcttaagctcgggccccaaataatgattttattttgactgatagtgacctgttcgttgcaacacattgatgagcaatgcttttttataatgccaactttgtacaaaaaagcaggctctctggtgccacgcggttctggttcttccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatag

SEQ ID NO: 144 - protein, 560 aa, Artificial Sequence
  MISTIC fusion protein / protein domain pMis-CRFR1
  MISC_FEATURE (1)..(164): pMis sequence
  MISC_FEATURE (165)..(560): CRFR1 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKEGSGSGHMHHHHHHSSGGSSTSLYKKAGSLVPRGSGSGSSLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 145 - DNA, 2137 bp, Artificial Sequence
  MISTIC fusion protein / protein domain pMisT-CRFR1
  misc_feature (1)..(654): pMisT sequence
  misc_feature (655)..(2137): CRFR1 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaggttctggttctggccatatgcaccatcatcatcatcattcttctggtggatcatcaacaagtttgtacaaaaaagcaggctctctggtgccacgcggttctgtaaaacgacggccagtcttaagctcgggccccaaataatgattttattttgactgatagtgacctgttcgttgcaacacattgatgagcaatgcttttttataatgccaactttgtacaaaaaagcaggctctctggtgccacgcggttctggttcttccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatag

SEQ ID NO: 146 - protein, 614 aa, Artificial Sequence
  MISTIC fusion protein / protein domain pMisT-CRFR1
  MISC_FEATURE (1)..(218): pMisT sequence
  MISC_FEATURE (219)..(614): CRFR1 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKELVPRGSMSAPDSWRERLYIVIFQTDTRDGRRFDSALLLVILASLLVVMIDSIDEGSGSGHMHHHHHHSSGGSSTSLYKKAGSLVPRGSGSGSSLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 147 - DNA, 2014 bp, Artificial Sequence
  MISTIC fusion protein / protein domain pMis-CRFR2b
  misc_feature (1)..(492): pMis sequence
  misc_feature (493)..(2014): CRFR2b sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaggttctggttctggccatatgcaccatcatcatcatcattcttctggtggatcatcaacaagtttgtacaaaaaagcaggctctctggtgccacgcggttctgtaaaacgacggccagtcttaagctcgggccccaaataatgattttattttgactgatagtgacctgttcgttgcaacacattgatgagcaatgcttttttataatgccaactttgtacaaaaaagcaggctctctggtgccacgcggttctggttctcaaccaggccaggcaccccaggaccagcccctgtggacacttttggagcagtactgccacaggaccacaattgggaatttttcaggtccctacacctactgcaacacgaccttggaccagatcgggacctgctggccacagagcgcacccggagccctagtagagagaccgtgccccgagtacttcaatggcatcaagtacaacacgacccggaatgcctacagagagtgcctggagaacgggacctgggcctcaagggtcaactactcacactgcgaacccattttggatgacaagcagagaaagtatgacctgcattaccgaatcgccctcattgtcaactacctgggtcactgtgtttccgtggtggccctggtggccgctttcctgcttttcctagtgctgcggagtatccgctgcctgaggaatgtgatccactggaacctcatcaccaccttcattctgagaaacatcgcgtggttcctgctgcaactcatcgaccacgaagtgcacgagggcaatgaggtctggtgccgctgcatcaccaccatcttcaactattttgtggtcaccaacttcttctggatgtttgtggagggctgctacctgcacacggccattgtcatgacgtactccacagagcacctgcgcaagtggcttttcctcttcattggatggtgcattccctgccctatcatcatcgcctgggcagttggcaaactctactatgagaatgagcagtgctggtttggcaaggaagctggtgatttggtggactacatctaccagggccccgtcatgcttgtgctgttgatcaattttgtatttctgtttaacatcgtcaggatcctgatgacgaagttacgagcatccaccacgtccgagacaatccaatacaggaaggcagtgaaggccacgctggtcctcctccccctgttgggcatcacctacatgctcttctttgtcaatcctggcgaggacgacctgtcccagattgtgttcatctacttcaactctttcctgcagtccttccagggtttctttgtgtccgttttctactgcttcttcaatggagaggtgcgcgcggccctgagaaagcggtggcaccgctggcaggaccaccacgccctccgggtgcctgtggcccgggccatgtccatccctacgtcgcccaccaggatcagcttccacagcatcaagcagacagctgctgtgtgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatag

SEQ ID NO: 148 - protein, 573 aa, Artificial Sequence
  MISTIC fusion protein / protein domain pMis-CRFR2b
  MISC_FEATURE (1)..(164): pMis sequence
  MISC_FEATURE (165)..(573): CRFR2b sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKEGSGSGHMHHHHHHSSGGSSTSLYKKAGSLVPRGSGSGSQPGQAPQDQPLWTLLEQYCHRTTIGNFSGPYTYCNTTLDQIGTCWPQSAPGALVERPCPEYFNGIKYNTTRNAYRECLENGTWASRVNYSHCEPILDDKQRKYDLHYRIALIVNYLGHCVSVVALVAAFLLFLVLRSIRCLRNVIHWNLITTFILRNIAWFLLQLIDHEVHEGNEVWCRCITTIFNYFVVTNFFWMFVEGCYLHTAIVMTYSTEHLRKWLFLFIGWCIPCPIIIAWAVGKLYYENEQCWFGKEAGDLVDYIYQGPVMLVLLINFVFLFNIVRILMTKLRASTTSETIQYRKAVKATLVLLPLLGITYMLFFVNPGEDDLSQIVFIYFNSFLQSFQGFFVSVFYCFFNGEVRAALRKRWHRWQDHHALRVPVARAMSIPTSPTRISFHSIKQTAAV

SEQ ID NO: 149 - DNA, 2176 bp, Artificial Sequence
  MISTIC fusion protein / protein domain pMisT-CRFR2b
  misc_feature (1)..(654): pMisT sequence
  misc_feature (655)..(2176): CRFR2b sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaggttctggttctggccatatgcaccatcatcatcatcattcttctggtggatcatcaacaagtttgtacaaaaaagcaggctctctggtgccacgcggttctgtaaaacgacggccagtcttaagctcgggccccaaataatgattttattttgactgatagtgacctgttcgttgcaacacattgatgagcaatgcttttttataatgccaactttgtacaaaaaagcaggctctctggtgccacgcggttctggttctcaaccaggccaggcaccccaggaccagcccctgtggacacttttggagcagtactgccacaggaccacaattgggaatttttcaggtccctacacctactgcaacacgaccttggaccagatcgggacctgctggccacagagcgcacccggagccctagtagagagaccgtgccccgagtacttcaatggcatcaagtacaacacgacccggaatgcctacagagagtgcctggagaacgggacctgggcctcaagggtcaactactcacactgcgaacccattttggatgacaagcagagaaagtatgacctgcattaccgaatcgccctcattgtcaactacctgggtcactgtgtttccgtggtggccctggtggccgctttcctgcttttcctagtgctgcggagtatccgctgcctgaggaatgtgatccactggaacctcatcaccaccttcattctgagaaacatcgcgtggttcctgctgcaactcatcgaccacgaagtgcacgagggcaatgaggtctggtgccgctgcatcaccaccatcttcaactattttgtggtcaccaacttcttctggatgtttgtggagggctgctacctgcacacggccattgtcatgacgtactccacagagcacctgcgcaagtggcttttcctcttcattggatggtgcattccctgccctatcatcatcgcctgggcagttggcaaactctactatgagaatgagcagtgctggtttggcaaggaagctggtgatttggtggactacatctaccagggccccgtcatgcttgtgctgttgatcaattttgtatttctgtttaacatcgtcaggatcctgatgacgaagttacgagcatccaccacgtccgagacaatccaatacaggaaggcagtgaaggccacgctggtcctcctccccctgttgggcatcacctacatgctcttctttgtcaatcctggcgaggacgacctgtcccagattgtgttcatctacttcaactctttcctgcagtccttccagggtttctttgtgtccgttttctactgcttcttcaatggagaggtgcgcgcggccctgagaaagcggtggcaccgctggcaggaccaccacgccctccgggtgcctgtggcccgggccatgtccatccctacgtcgcccaccaggatcagcttccacagcatcaagcagacagctgctgtgtgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatag

SEQ ID NO: 150 - protein, 627 aa, Artificial Sequence
  MISTIC fusion protein / protein domain pMisT-CRFR2b
  MISC_FEATURE (1)..(218): pMisT sequence
  MISC_FEATURE (219)..(627): CRFR2b sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKELVPRGSMSAPDSWRERLYIVIFQTDTRDGRRFDSALLLVILASLLVVMIDSIDEGSGSGHMHHHHHHSSGGSSTSLYKKAGSLVPRGSGSGSQPGQAPQDQPLWTLLEQYCHRTTIGNFSGPYTYCNTTLDQIGTCWPQSAPGALVERPCPEYFNGIKYNTTRNAYRECLENGTWASRVNYSHCEPILDDKQRKYDLHYRIALIVNYLGHCVSVVALVAAFLLFLVLRSIRCLRNVIHWNLITTFILRNIAWFLLQLIDHEVHEGNEVWCRCITTIFNYFVVTNFFWMFVEGCYLHTAIVMTYSTEHLRKWLFLFIGWCIPCPIIIAWAVGKLYYENEQCWFGKEAGDLVDYIYQGPVMLVLLINFVFLFNIVRILMTKLRASTTSETIQYRKAVKATLVLLPLLGITYMLFFVNPGEDDLSQIVFIYFNSFLQSFQGFFVSVFYCFFNGEVRAALRKRWHRWQDHHALRVPVARAMSIPTSPTRISFHSIKQTAAV

SEQ ID NO: 151 - DNA, 2661 bp, Artificial Sequence
  MISTIC fusion protein / protein domain pMis-CD97
  misc_feature (1)..(492): pMis sequence
  misc_feature (493)..(2661): CD97 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaggttctggttctggccatatgcaccatcatcatcatcattcttctggtggatcatcaacaagtttgtacaaaaaagcaggctctctggtgccacgcggttctcaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatga

SEQ ID NO: 152 - protein, 886 aa, Artificial Sequence
  MISTIC fusion protein / protein domain pMis-CD97
  MISC_FEATURE (1)..(164): pMis sequence
  MISC_FEATURE (165)..(886): CD97 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKEGSGSGHMHHHHHHSSGGSSTSLYKKAGSLVPRGSQDSRGCARWCPQNSSCVNATACRCNPGFSSFSEIITTPTETCDDINECATPSKVSCGKFSDCWNTEGSYDCVCSPGYEPVSGAKTFKNESENTCQDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 153 - DNA, 2823 bp, Artificial Sequence
  MISTIC fusion protein / protein domain pMisT-CD97
  misc_feature (1)..(654): pMisT sequence
  misc_feature (655)..(2823): CD97 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaggttctggttctggccatatgcaccatcatcatcatcattcttctggtggatcatcaacaagtttgtacaaaaaagcaggctctctggtgccacgcggttctcaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatga

SEQ ID NO: 154 - protein, 940 aa, Artificial Sequence [sequence omitted]

SEQ ID NO: 155 - DNA, 1855 bp, Artificial Sequence
  MISTIC fusion protein / protein domain pMis-CCR5
  misc_feature (1)..(492): pMis sequence
  misc_feature (493)..(1855): CCR5 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaggttctggttctggccatatgcaccatcatcatcatcattcttctggtggatcatcaacaagtttgtacaaaaaagcaggctctctggtgccacgcggttctgtaaaacgacggccagtcttaagctcgggccccaaataatgattttattttgactgatagtgacctgttcgttgcaacacattgatgagcaatgcttttttataatgccaactttgtacaaaaaagcaggctctctggtgccacgcggttctggttctatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatag

SEQ ID NO: 156 - protein, 520 aa, Artificial Sequence
  MISTIC fusion protein / protein domain pMis-CCR5
  MISC_FEATURE (1)..(164): pMis sequence
  MISC_FEATURE (165)..(520): CCR5 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKEGSGSGHMHHHHHHSSGGSSTSLYKKAGSLVPRGSGSGSMDYQVSSPIYDINYYTSEPCQKINVKQIAARLLPPLYSLVFIFGFVGNMLVILILINCKRLKSMTDIYLLNLAISDLFFLLTVPFWAHYAAAQWDFGNTMCQLLTGLYFIGFFSGIFFIILLTIDRYLAVVHAVFALKARTVTFGVVTSVITWVVAVFASLPGIIFTRSQKEGLHYTCSSHFPYSQYQFWKNFQTLKIVILGLVLPLLVMVICYSGILKTLLRCRNEKKRHRAVRLIFTIMIVYFLFWAPYNIVLLLNTFQEFFGLNNCSSSNRLDQAMQVTETLGMTHCCINPIIYAFVGEKFRNYLLVFFQKHIAKRFCKCCSIFQQEAPERASSVYTRSTGEQEISVGL

SEQ ID NO: 157 - DNA, 2017 bp, Artificial Sequence
  MISTIC fusion protein / protein domain pMisT-CCR5
  misc_feature (1)..(654): pMisT sequence
  misc_feature (655)..(2017): CRR5 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaggttctggttctggccatatgcaccatcatcatcatcattcttctggtggatcatcaacaagtttgtacaaaaaagcaggctctctggtgccacgcggttctgtaaaacgacggccagtcttaagctcgggccccaaataatgattttattttgactgatagtgacctgttcgttgcaacacattgatgagcaatgcttttttataatgccaactttgtacaaaaaagcaggctctctggtgccacgcggttctggttctatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatag

SEQ ID NO: 158 - protein, 574 aa, Artificial Sequence [sequence omitted]

SEQ ID NO: 159 - DNA, 1566 bp, Artificial Sequence
  MISTIC fusion protein / protein domain pMis-RAI3
  misc_feature (1)..(492): pMis sequence
  misc_feature (493)..(1566): RAI3 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaggttctggttctggccatatgcaccatcatcatcatcattcttctggtggatcatcaacaagtttgtacaaaaaagcaggctctctggtgccacgcggttctatggctacaacagtccctgatggttgccgcaatggcctgaaatccaagtactacagactttgtgataaggctgaagcttggggcatcgtcctagaaacggtggccacagctggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaa

SEQ ID NO: 160 - protein, 521 aa, Artificial Sequence [sequence omitted]

SEQ ID NO: 161 - DNA, 1728 bp, Artificial Sequence
  MISTIC fusion protein / protein domain pMisT-RAI3
  misc_feature (1)..(654): pMisT sequence
  misc_feature (655)..(1728): RAI3 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaggttctggttctggccatatgcaccatcatcatcatcattcttctggtggatcatcaacaagtttgtacaaaaaagcaggctctctggtgccacgcggttctatggctacaacagtccctgatggttgccgcaatggcctgaaatccaagtactacagactttgtgataaggctgaagcttggggcatcgtcctagaaacggtggccacagctggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaa

SEQ ID NO: 162 - protein, 575 aa, Artificial Sequence [sequence omitted]

SEQ ID NO: 163 - DNA, 1620 bp, Artificial Sequence
  MISTIC fusion protein / protein domain pMis-GPRC5B
  misc_feature (1)..(492): pMis sequence
  misc_feature (493)..(1620): GPRC5B sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaggttctggttctggccatatgcaccatcatcatcatcattcttctggtggatcatcaacaagtttgtacaaaaaagcaggctctctggtgccacgcggttctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtga

SEQ ID NO: 164 - protein, 539 aa, Artificial Sequence
  MISTIC fusion protein / protein domain pMis-GPRC5B
  MISC_FEATURE (1)..(164): pMis sequence
  MISC_FEATURE (165)..(539): GPRC5B sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKEGSGSGHMHHHHHHSSGGSSTSLYKKAGSLVPRGSENASTSRGCGLDLLPQYVSLCDLDAIWGIVVEAVAGAGALITLLLMLILLVRLPFIKEKEKKSPVGLHFLFLLGTLGLFGLTFAFIIQEDETICSVRRFLWGVLFALCFSCLLSQAWRVRRLVRHGTGPAGWQLVGLALCLMLVQVIIAVEWLVLTVLRDTRPACAYEPMDFVMALIYDMVLLVVTLGLALFTLCGKFKRWKLNGAFLLITAFLSVLIWVAWMTMYLFGNVKLQQGDAWNDPTLAITLAASGWVFVIFHAIPEIHCTLLPALQENTPNYFDTSQPRMRETAFEEDVQLPRAYMENKAFSMDEHNAALRTAGFPNGSLGKRPSGSLGKRPSAPFRSNVYQPTEMAVVLNGGTIPTAPPSHTGRHLW

SEQ ID NO: 165 - DNA, 1782 bp, Artificial Sequence
  MISTIC fusion protein / protein domain pMisT-GPRC5B
  misc_feature (1)..(654): pMisT sequence
  misc_feature (655)..(1782): GPRC5B sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaggttctggttctggccatatgcaccatcatcatcatcattcttctggtggatcatcaacaagtttgtacaaaaaagcaggctctctggtgccacgcggttctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtga

SEQ ID NO: 166 - protein, 593 aa, Artificial Sequence [sequence omitted]

SEQ ID NO: 167 - DNA, 2508 bp, Artificial Sequence
  MISTIC fusion protein / protein domain pMis-ETL
  misc_feature (1)..(492): pMis sequence
  misc_feature (493)..(2508): ETL sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaggttctggttctggccatatgcaccatcatcatcatcattcttctggtggatcatcaacaagtttgtacaaaaaagcaggctctctggtgccacgcggttctcaaaattgcaccaagacaccttgtctcccaaatgcaaaatgtgaaatacgcaatggaattgaagcctgctattgcaacatgggattttcaggaaatggtgtcacaatttgtgaagatgataatgaatgtggaaatttaactcagtcctgtggcgaaaatgctaattgcactaacacagaaggaagttattattgtatgtgtgtacctggcttcagatccagcagtaaccaagacaggtttatcactaatgatggaaccgtctgtatagaaaatgtgaatgcaaactgccatttagataatgtctgtatagctgcaaatattaataaaactttaacaaaaatcagatccataaaagaacctgtggctttgctacaagaagtctatagaaattctgtgacagatctttcaccaacagatataattacatatatagaaatattagctgaatcatcttcattactaggttacaagaacaacactatctcagccaaggacaccctttctaactcaactcttactgaatttgtaaaaaccgtgaataattttgttcaaagggatacatttgtagtttgggacaagttatctgtgaatcataggagaacacatcttacaaaactcatgcacactgttgaacaagctactttaaggatatcccagagcttccaaaagaccacagagtttgatacaaattcaacggatatagctctcaaagttttcttttttgattcatataacatgaaacatattcatcctcatatgaatatggatggagactacataaatatatttccaaagagaaaagctgcatatgattcaaatggcaatgttgcagttgcatttttatattataagagtattggtcctttgctttcatcatctgacaacttcttattgaaacctcaaaattatgataattctgaagaggaggaaagagtcatatcttcagtaatttcagtctcaatgagctcaaacccacccacattatatgaacttgaaaaaataacatttacattaagtcatcgaaaggtcacagataggtataggagtctatgtgcattttggaattactcacctgataccatgaatggcagctggtcttcagagggctgtgagctgacatactcaaatgagacccacacctcatgccgctgtaatcacctgacacattttgcaattttgatgtcctctggtccttccattggtattaaagattataatattcttacaaggatcactcaactaggaataattatttcactgatttgtcttgccatatgcatttttaccttctggttcttcagtgaaattcaaagcaccaggacaacaattcacaaaaatctttgctgtagcctatttcttgctgaacttgtttttcttgttgggatcaatacaaatactaataagctcttctgttcaatcattgctggactgctacactacttctttttagctgcttttgcatggatgtgcattgaaggcatacatctctatctcattgttgtgggtgtcatctacaacaagggatttttgcacaagaatttttatatctttggctatctaagcccagccgtggtagttggattttcggcagcactaggatacagatattatggcacaaccaaagtatgttggcttagcaccgaaaacaactttatttggagttttataggaccagcatgcctaatcattcttgttaatctcttggcttttggagtcatcatatacaaagtttttcgtcacactgcagggttgaaaccagaagttagttgctttgagaacataaggtcttgtgcaagaggagccctcgctcttctgttccttctcggcaccacctggatctttggggttctccatgttgtgcacgcatcagtggttacagcttacctcttcacagtcagcaatgctttccaggggatgttcatttttttattcctgtgtgttttatctagaaagattcaagaagaatattacagattgttcaaaaatgtcccctgttgttttggatgtttaaggtaa

SEQ ID NO: 168 - protein, 835 aa, Artificial Sequence
  MISTIC fusion protein / protein domain pMis-ETL
  MISC_FEATURE (1)..(164): pMis sequence
  MISC_FEATURE (165)..(835): ETL sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKEGSGSGHMHHHHHHSSGGSSTSLYKKAGSLVPRGSQNCTKTPCLPNAKCEIRNGIEACYCNMGFSGNGVTICEDDNECGNLTQSCGENANCTNTEGSYYCMCVPGFRSSSNQDRFITNDGTVCIENVNANCHLDNVCIAANINKTLTKIRSIKEPVALLQEVYRNSVTDLSPTDIITYIEILAESSSLLGYKNNTISAKDTLSNSTLTEFVKTVNNFVQRDTFVVWDKLSVNHRRTHLTKLMHTVEQATLRISQSFQKTTEFDTNSTDIALKVFFFDSYNMKHIHPHMNMDGDYINIFPKRKAAYDSNGNVAVAFLYYKSIGPLLSSSDNFLLKPQNYDNSEEEERVISSVISVSMSSNPPTLYELEKITFTLSHRKVTDRYRSLCAFWNYSPDTMNGSWSSEGCELTYSNETHTSCRCNHLTHFAILMSSGPSIGIKDYNILTRITQLGIIISLICLAICIFTFWFFSEIQSTRTTIHKNLCCSLFLAELVFLVGINTNTNKLFCSIIAGLLHYFFLAAFAWMCIEGIHLYLIVVGVIYNKGFLHKNFYIFGYLSPAVVVGFSAALGYRYYGTTKVCWLSTENNFIWSFIGPACLIILVNLLAFGVIIYKVFRHTAGLKPEVSCFENIRSCARGALALLFLLGTTWIFGVLHVVHASVVTAYLFTVSNAFQGMFIFLFLCVLSRKIQEEYYRLFKNVPCCFGCLR

SEQ ID NO: 169 - DNA, 2670 bp, Artificial Sequence
  MISTIC fusion protein / protein domain pMisT-ETL
  misc_feature (1)..(654): pMisT sequence
  misc_feature (655)..(2670): ETL sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaggttctggttctggccatatgcaccatcatcatcatcattcttctggtggatcatcaacaagtttgtacaaaaaagcaggctctctggtgccacgcggttctcaaaattgcaccaagacaccttgtctcccaaatgcaaaatgtgaaatacgcaatggaattgaagcctgctattgcaacatgggattttcaggaaatggtgtcacaatttgtgaagatgataatgaatgtggaaatttaactcagtcctgtggcgaaaatgctaattgcactaacacagaaggaagttattattgtatgtgtgtacctggcttcagatccagcagtaaccaagacaggtttatcactaatgatggaaccgtctgtatagaaaatgtgaatgcaaactgccatttagataatgtctgtatagctgcaaatattaataaaactttaacaaaaatcagatccataaaagaacctgtggctttgctacaagaagtctatagaaattctgtgacagatctttcaccaacagatataattacatatatagaaatattagctgaatcatcttcattactaggttacaagaacaacactatctcagccaaggacaccctttctaactcaactcttactgaatttgtaaaaaccgtgaataattttgttcaaagggatacatttgtagtttgggacaagttatctgtgaatcataggagaacacatcttacaaaactcatgcacactgttgaacaagctactttaaggatatcccagagcttccaaaagaccacagagtttgatacaaattcaacggatatagctctcaaagttttcttttttgattcatataacatgaaacatattcatcctcatatgaatatggatggagactacataaatatatttccaaagagaaaagctgcatatgattcaaatggcaatgttgcagttgcatttttatattataagagtattggtcctttgctttcatcatctgacaacttcttattgaaacctcaaaattatgataattctgaagaggaggaaagagtcatatcttcagtaatttcagtctcaatgagctcaaacccacccacattatatgaacttgaaaaaataacatttacattaagtcatcgaaaggtcacagataggtataggagtctatgtgcattttggaattactcacctgataccatgaatggcagctggtcttcagagggctgtgagctgacatactcaaatgagacccacacctcatgccgctgtaatcacctgacacattttgcaattttgatgtcctctggtccttccattggtattaaagattataatattcttacaaggatcactcaactaggaataattatttcactgatttgtcttgccatatgcatttttaccttctggttcttcagtgaaattcaaagcaccaggacaacaattcacaaaaatctttgctgtagcctatttcttgctgaacttgtttttcttgttgggatcaatacaaatactaataagctcttctgttcaatcattgctggactgctacactacttctttttagctgcttttgcatggatgtgcattgaaggcatacatctctatctcattgttgtgggtgtcatctacaacaagggatttttgcacaagaatttttatatctttggctatctaagcccagccgtggtagttggattttcggcagcactaggatacagatattatggcacaaccaaagtatgttggcttagcaccgaaaacaactttatttggagttttataggaccagcatgcctaatcattcttgttaatctcttggcttttggagtcatcatatacaaagtttttcgtcacactgcagggttgaaaccagaagttagttgctttgagaacataaggtcttgtgcaagaggagccctcgctcttctgttccttctcggcaccacctggatctttggggttctccatgttgtgcacgcatcagtggttacagcttacctcttcacagtcagcaatgctttccaggggatgttcatttttttattcctgtgtgttttatctagaaagattcaagaagaatattacagattgttcaaaaatgtcccctgttgttttggatgtttaaggtaa

SEQ ID NO: 170 - protein, 889 aa, Artificial Sequence [sequence omitted]

SEQ ID NO: 171 - DNA, 2940 bp, Artificial Sequence
  MISTIC fusion protein / protein domain pMis-GABABR1
  misc_feature (1)..(492): pMis sequence
  misc_feature (493)..(2940): GABABR1 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaggttctggttctggccatatgcaccatcatcatcatcattcttctggtggatcatcaacaagtttgtacaaaaaagcaggctctctggtgccacgcggttcttcccactccccccatctcccgcggcctcactcgcgggtccccccgcacccatcctcagaacggcgcgcagtgtacatcggggcactgtttcccatgagcgggggctggccagggggccaggccagccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtga

SEQ ID NO: 172 - protein, 979 aa, Artificial Sequence
  MISTIC fusion protein / protein domain pMis-GABABR1
  MISC_FEATURE (1)..(164): pMis sequence
  MISC_FEATURE (165)..(979): GABABR1 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKEGSGSGHMHHHHHHSSGGSSTSLYKKAGSLVPRGSSHSPHLPRPHSRVPPHPSSERRAVYIGALFPMSGGWPGGQASQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 173 - DNA, 3102 bp, Artificial Sequence
  MISTIC fusion protein / protein domain pMisT-GABABR1
  misc_feature (1)..(654): pMisT sequence
  misc_feature (655)..(3102): GABABR1 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaggttctggttctggccatatgcaccatcatcatcatcattcttctggtggatcatcaacaagtttgtacaaaaaagcaggctctctggtgccacgcggttcttcccactccccccatctcccgcggcctcactcgcgggtccccccgcacccatcctcagaacggcgcgcagtgtacatcggggcactgtttcccatgagcgggggctggccagggggccaggccagccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtga

SEQ ID NO: 174 - protein, 1033 aa, Artificial Sequence
  MISTIC fusion protein / protein domain pMisT-GABABR1
  MISC_FEATURE (1)..(218): pMisT sequence
  MISC_FEATURE (219)..(1033): GABABR1 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKELVPRGSMSAPDSWRERLYIVIFQTDTRDGRRFDSALLLVILASLLVVMIDSIDEGSGSGHMHHHHHHSSGGSSTSLYKKAGSLVPRGSSHSPHLPRPHSRVPPHPSSERRAVYIGALFPMSGGWPGGQASQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 175 - DNA, 1749 bp, Artificial Sequence
  MISTIC fusion protein / protein domain pMis-VIPR2
  misc_feature (1)..(492): pMis sequence
  misc_feature (493)..(1749): VIPR2 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaggttctggttctggccatatgcaccatcatcatcatcattcttctggtggatcatcaacaagtttgtacaaaaaagcaggctctctggtgccacgcggttctattcacccagaatgccgatttcatctggaaatacaggaggaagaaacaaaatgtgcagagcttctgaggtctcaaacagaaaaacacaaagcctgcagtggcgtctgggacaacatcacgtgctggcggcctgccaatgtgggagagaccgtcacggtgccctgcccaaaagtcttcagcaatttttacagcaaagcaggaaacataagcaaaaactgtacgagtgacggatggtcagagacgttcccagatttcgtcgatgcctgtggctacagcgacccggaggatgagagcaagatcacgttttatattctggtgaaggccatttataccctgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctag

SEQ ID NO: 176 - protein, 582 aa, Artificial Sequence
  MISTIC fusion protein / protein domain pMis-VIPR2
  MISC_FEATURE (1)..(164): pMis sequence
  MISC_FEATURE (165)..(582): VIPR2 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKEGSGSGHMHHHHHHSSGGSSTSLYKKAGSLVPRGSIHPECRFHLEIQEEETKCAELLRSQTEKHKACSGVWDNITCWRPANVGETVTVPCPKVFSNFYSKAGNISKNCTSDGWSETFPDFVDACGYSDPEDESKITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 177 - DNA, 1911 bp, Artificial Sequence
  MISTIC fusion protein / protein domain pMisT-VIPR2
  misc_feature (1)..(654): pMisT sequence
  misc_feature (655)..(1911): VIPR2 sequence
atgaaacaccaccaccaccaccaccaccacggtggtctggttccgcgtggttcccatggcatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaactagttccgcggggatcaatgagcgcacccgacagctggcgcgaacgcctctacatcgtcatcttccagaccgacacccgcgacggccggcgcttcgacagcgcgctgctgctggtgatcctggccagcctgctggtagtgatgatcgacagcatcgacgaaggttctggttctggccatatgcaccatcatcatcatcattcttctggtggatcatcaacaagtttgtacaaaaaagcaggctctctggtgccacgcggttctattcacccagaatgccgatttcatctggaaatacaggaggaagaaacaaaatgtgcagagcttctgaggtctcaaacagaaaaacacaaagcctgcagtggcgtctgggacaacatcacgtgctggcggcctgccaatgtgggagagaccgtcacggtgccctgcccaaaagtcttcagcaatttttacagcaaagcaggaaacataagcaaaaactgtacgagtgacggatggtcagagacgttcccagatttcgtcgatgcctgtggctacagcgacccggaggatgagagcaagatcacgttttatattctggtgaaggccatttataccctgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctag

SEQ ID NO: 178 - protein, 636 aa, Artificial Sequence
  MISTIC fusion protein / protein domain pMisT-VIPR2
  MISC_FEATURE (1)..(218): pMisT sequence
  MISC_FEATURE (219)..(636): VIPR2 sequence
MKHHHHHHHHGGLVPRGSHGMFCTFFEKHHRKWDILLEKSTGVMEAMKVTSEEKEQLSTAIDRMNEGLDAFIQLYNESEIDEPLIQLDDDTAELMKQARDMYGQEKLNEKLNTIIKQILSISVSEEGEKELVPRGSMSAPDSWRERLYIVIFQTDTRDGRRFDSALLLVILASLLVVMIDSIDEGSGSGHMHHHHHHSSGGSSTSLYKKAGSLVPRGSIHPECRFHLEIQEEETKCAELLRSQTEKHKACSGVWDNITCWRPANVGETVTVPCPKVFSNFYSKAGNISKNCTSDGWSETFPDFVDACGYSDPEDESKITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 179 - DNA, 32 bp, Artificial Sequence
  Oligonucleotide primer/probe
tcagggccatggcatgttttgtacattttttg

SEQ ID NO: 180 - DNA, 24 bp, Artificial Sequence
  Oligonucleotide primer/probe
tcaggaattcagcttgattccgtt

SEQ ID NO: 181 - protein, 21 aa, Artificial Sequence
  Exemplar Exogenous Helix
FDSALLLVILASLLVVMIDSI

SEQ ID NO: 182 - protein, 25 aa, Artificial Sequence
  Exemplar Exogenous Helix
TSNALAAVAAALAAVAAALAAVATS

SEQ ID NO: 183 - protein, 31 aa, Artificial Sequence
  Exemplar Exogenous Helix
WNALAAVAAALAAVAAALAAVAASKSKSKSK

SEQ ID NO: 184 - DNA, 1380 bp, Rattus rattus
gtctggagggcctttgagaacccccacaccagcaccatggccctggtgttctactatgtgaccgggttcttcattgccgtctcagtcatcgcgaatgtggtggaaacagttccatgtgggtctagcccaggccacataaaagaactgccttgtggggaaaggtatgcagtggccttcttctgcttggataccgcctgtgtcatgatctttacggttgagtacttgctacgcctggccgcagcgcctagtcgttaccgttttgtgcgcagtgtcatgagtatcatcgatgtggtggccatcctaccctattacattgggctggtgatgacagacaatgaggatgtcagtggcgcctttgtcacactccgagtctttcgagtcttcaggatctttaagttttcccgccactctcaaggcctgcgtatactggggtacacactgaagagctgtgcgtcagaactgggcttcttgctcttttccctcacaatggctatcatcattttcgctacggttatgttctacgcagagaagggctcttcagcaagcaagttcaccagcatccctgcagccttctggtacaccatcgtcaccatgacaacactggggtatggcgacatggtaccaaaaaccatagcagggaagattttcgggtctatctgctcactgagcggagtcttggtcatcgcgctacccgtgcctgtgatcgtgtctaacttcagtcggatctaccaccaaaaccaacgagcggacaaacgaagggcacagaagaaagcgaggctggccaggatccgggcagccaaaagtggaagtgcaaatgcctacatgcagagcaagcggaatgggttactgagcaaccaactgcagtcctcggaggatgaaccggccttcgttagcaaatctggatccagcttcgagacacaacaccaccacctgcttcactgcctggagaaaaccacgaaccatgagtttgtggatgaacaagtctttgaagaaagctgcatggaagtggccactgttaatcgcccttcaagtcacagcccctccctctcttcccaacaaggagtcaccagcacttgctgctcacggagacacaaaaaatctttccgaatcccaaatgccaatgtgtcaggaagtcatagaggcagcgtgcaagaactcagtacaattcagatcagatgtgtggagagaactccactatccaacagccgatccagcttaaatgccaaaatggaagagtgtgtcaaactaaactgtgaacaaccttacgtgaccacagcaataattagcattccaacacctccagtaaccaccccagaaggcgacgacaggcccgagtctcctgagtattcgggaggaaacatcgtcagggtgtctgctttg

SEQ ID NO: 185 - protein, 460 aa, Rattus rattus
VWRAFENPHTSTMALVFYYVTGFFIAVSVIANVVETVPCGSSPGHIKELPCGERYAVAFFCLDTACVMIFTVEYLLRLAAAPSRYRFVRSVMSIIDVVAILPYYIGLVMTDNEDVSGAFVTLRVFRVFRIFKFSRHSQGLRILGYTLKSCASELGFLLFSLTMAIIIFATVMFYAEKGSSASKFTSIPAAFWYTIVTMTTLGYGDMVPKTIAGKIFGSICSLSGVLVIALPVPVIVSNFSRIYHQNQRADKRRAQKKARLARIRAAKSGSANAYMQSKRNGLLSNQLQSSEDEPAFVSKSGSSFETQHHHLLHCLEKTTNHEFVDEQVFEESCMEVATVNRPSSHSPSLSSQQGVTSTCCSRRHKKSFRIPNANVSGSHRGSVQELSTIQIRCVERTPLSNSRSSLNAKMEECVKLNCEQPYVTTAIISIPTPPVTTPEGDDRPESPEYSGGNIVRVSAL

SEQ ID NO: 186 - DNA, 47 bp, Artificial Sequence
  Primer
atgctaatacgactcactataggggctctttactttaaattgtgccc

SEQ ID NO: 187 - DNA, 60 bp, Artificial Sequence
  Primer
  misc_feature (31)..(31): n = any nucleotide
  misc_feature (34)..(34): n = any nucleotide
  misc_feature (37)..(37): n = any nucleotide
  misc_feature (40)..(40): n = any nucleotide
  misc_feature (43)..(43): n = any nucleotide
  misc_feature (46)..(46): n = any nucleotide
  misc_feature (58)..(58): n = any nucleotide
atggctagttattgctcagcggccgactgwnganacngtnabnabngcccaccadatncc

SEQ ID NO: 188 - DNA, 255 bp, Bacillus subtilis
atgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggagaaaaagaatga

SEQ ID NO: 189 - protein, 84 aa, Bacillus subtilis
MKVTSEEKEQLSTAIDRMNEGLDAFIQLYNESEIDEPLIQLDDDTAELMKQARDMYGQEKLNEKLNTIIKQILSISVSEEGEKE

SEQ ID NO: 190 - DNA, 255 bp, Bacillus licheniformis
gtgaaagtaacggatcaggaaaaagaacagttaagcacggcgatcgataaaatgaatgaagggcttgatgcgttcattcttctctataacgaatcggaaaaggacgagcagctgatcgaatttgaagaagaaacggcagagatgatcagacaagcgattgaacagcacgggaaagttagcaccaatcaaaagttaaatgcgatcatcaaagaaattttatcattttccctgcggaaagacggtgaagaagcatga

SEQ ID NO: 191 - protein, 84 aa, Bacillus licheniformis
MKVTDQEKEQLSTAIDKMNEGLDAFILLYNESEKDEQLIEFEEETAEMIRQAIEQHGKVSTNQKLNAIIKEILSFSLRKDGEEA

SEQ ID NO: 192 - DNA, 255 bp, Bacillus mojavensis
atgaaagtgacgagtgaggaaaaggaacagctgagtacagcgattgaccgaatgaatgaaggactggacgtatttatccagttttataatgaatctgaaatcgatgaaccccttattcagctggaagacgatacagctgatctcatgaagcaggcccgcgacctgtacggccaggaaaagctaaatgagaagctgaacacaattatcaaacagattttatctatttcattatctgaagaaggagaaaaagaatga

SEQ ID NO: 193 - protein, 84 aa, Bacillus mojavensis
MKVTSEEKEQLSTAIDRMNEGLDVFIQFYNESEIDEPLIQLEDDTADLMKQARDLYGQEKLNEKLNTIIKQILSISLSEEGEKE

SEQ ID NO: 194 - DNA, 255 bp, Bacillus atrophaeus
atgaaagtgacaagtgacgagaaagaacagctaagcgctgcaattgaccggatgaatgaggggctggatgtatttattcagttttataacgaatcggaaaaagatgaaccgctgattcagcttgaggacgatacagccaaattaatgaaagaagcccgtgaattatacggacaggataagctgaacgaaacactaaatgccatcattaaacaaattttatctatttctctatcagaagaggggaagaaaaaatga

SEQ ID NO: 195 - protein, 84 aa, Bacillus atrophaeus
MKVTSDEKEQLSAAIDRMNEGLDVFIQFYNESEKDEPLIQLEDDTAKLMKEARELYGQDKLNETLNAIIKQILSISLSEEGKKK

SEQ ID NO: 196 - DNA, 1947 bp, Artificial Sequence
  Encodes M1-Alk3 Fusion Protein
atgaaacaccaccaccaccaccaccaccacggtggtctggttccgcgtggttcccatggcatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaggttctggttctggccatatgcaccatcatcatcatcattcttctggtggatcatcaacaagtttgtacaaaaaagcaggctctctggtgccacgcggttctggttctcagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcataactaatggacattgctttgccatcatagaagaagatgaccagggagaaaccacattagcttcagggtgtatgaaatatgaaggatctgattttcagtgcaaagattctccaaaagcccagctacgccggacaatagaatgttgtcggaccaatttatgtaaccagtatttgcaacccacactgccccctgttgtcataggtccgttttttgatggcagcattcgatggctggttttgctcatttctatggctgtctgcataattgctatgatcatcttctccagctgcttttgttacaaacattattgcaagagcatctcaagcagacgtcgttacaatcgtgatttggaacaggatgaagcatttattccagttggagaatcactaaaagaccttattgaccagtcacaaagttctggtagtgggtctggactacctttattggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcctccagactcacagcattgagaattaagaagacgcttgccaagatggttgaatcccaagatgtaaaaatc

SEQ ID NO: 197 - protein, 649 aa, Artificial Sequence
  M1-Alk3 Fusion Protein
  MISC_FEATURE (1)..(20): His tag and Linker residues
  MISC_FEATURE (21)..(104): Mistic (M1) domain
  MISC_FEATURE (105)..(140): Linker
  MISC_FEATURE (141)..(649): Alk3 Cargo Domain
MKHHHHHHHHGGLVPRGSHGMKVTSEEKEQLSTAIDRMNEGLDAFIQLYNESEIDEPLIQLDDDTAELMKQARDMYGQEKLNEKLNTIIKQILSISVSEEGEKEGSGSGHMHHHHHHSSGGSSTSLYKKAGSLVPRGSGSQNLDSMLHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIRWLVLLISMAVCIIAMIIFSSCFCYKHYCKSISSRRRYNRDLEQDEAFIPVGESLKDLIDQSQSSGSGSGLPLLVQRTIAKQIQMVRQVGKGRYGEVWMGKWRGEKVAVKVFFTTEEASWFRETEIYQTVLMRHENILGFIAADIKGTGSWTQLYLITDYHENGSLYDFLKCATLDTRALLKLAYSAACGLCHLHTEIYGTQGKPAIAHRDLKSKNILIKKNGSCCIADLGLAVKFNSDTNEVDVPLNTRVGTKRYMAPEVLDESLNKNHFQPYIMADIYSFGLIIWEMARRCITGGIVEEYQLPYYNMVPSDPSYEDMREVVCVKRLRPIVSNRWNSDECLRAVLKLMSECWAHNPASRLTALRIKKTLAKMVESQDVKI

SEQ ID NO: 198 - DNA, 1932 bp, Artificial Sequence
  Encodes M1-BMPRII Fusion Protein
atgaaacaccaccaccaccaccaccaccacggtggtctggttccgcgtggttcccatggcatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaggttctggttctggccatatgcaccatcatcatcatcattcttctggtggatcatcaacaagtttgtacaaaaaagcaggctctctggtgccacgcggttctggttcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtccacctcattcatttaaccgagatgagacaataatcattgctttggcatcagtctctgtattagctgttttgatagttgccttatgctttggatacagaatgttgacaggagaccgtaaacaaggtcttcacagtatgaacatgatggaggcagcagcatccgaaccctctcttgatctagataatctgaaactgttggagctgattggccgaggtcgatatggagcagtatataaaggctccttggatgagcgtccagttgctgtaaaagtgttttcctttgcaaaccgtcagaattttatcaacgaaaagaacatttacagagtgcctttgatggaacatgacaacattgcccgctttatagttggagatgagagagtcactgcagatggacgcatggaatatttgcttgtgatggagtactatcccaatggatctttatgcaagtatttaagtctccacacaagtgactgggtaagctcttgccgtcttgctcattctgttactagaggactggcttatcttcacacagaattaccacgaggagatcattataaacctgcaatttcccatcgagatttaaacagcagaaatgtcctagtgaaaaatgatggaacctgtgttattagtgactttggactgtccatgaggctgactggaaatagactggtgcgcccaggggaggaagataatgcagccataagcgaggttggcactatcagatatatggcaccagaagtgctagaaggagctgtgaacttgagggactgtgaatcagctttgaaacaagtagacatgtatgctcttggactaatctattgggagatatttatgagatgtacagacctcttcccaggggaatccgtaccagagtaccagatggcttttcagacagaggttggaaaccatcccacttttgaggatatgcaggttctcgtgtctagggaaaaacagagacccaagttcccagaagcctggaaagaaaatagcctggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacgtagg

SEQ ID NO: 199 - protein, 644 aa, Artificial Sequence
  M1-BMPRII Fusion Protein
  MISC_FEATURE (1)..(20): His tag and Linker residues
  MISC_FEATURE (21)..(104): Mistic (M1) domain
  MISC_FEATURE (105)..(140): Linker
  MISC_FEATURE (141)..(644): BMPRII Cargo Domain
MKHHHHHHHHGGLVPRGSHGMKVTSEEKEQLSTAIDRMNEGLDAFIQLYNESEIDEPLIQLDDDTAELMKQARDMYGQEKLNEKLNTIIKQILSISVSEEGEKEGSGSGHMHHHHHHSSGGSSTSLYKKAGSLVPRGSGSSQNQERLCAFKDPYQQDLGIGESRISHENGTILCSKGSTCYGLWEKSKGDINLVKQGCWSHIGDPQECHYEECVVTTTPPSIQNGTYRFCCCSTDLCNVNFTENFPPPDTTPLSPPHSFNRDETIIIALASVSVLAVLIVALCFGYRMLTGDRKQGLHSMNMMEAAASEPSLDLDNLKLLELIGRGRYGAVYKGSLDERPVAVKVFSFANRQNFINEKNIYRVPLMEHDNIARFIVGDERVTADGRMEYLLVMEYYPNGSLCKYLSLHTSDWVSSCRLAHSVTRGLAYLHTELPRGDHYKPAISHRDLNSRNVLVKNDGTCVISDFGLSMRLTGNRLVRPGEEDNAAISEVGTIRYMAPEVLEGAVNLRDCESALKQVDMYALGLIYWEIFMRCTDLFPGESVPEYQMAFQTEVGNHPTFEDMQVLVSREKQRPKFPEAWKENSLAVRSLKETIEDCWDQDAEARLTAQCAEERMAELMMIWERNKSVSPTVNPMSTAMQNERR

SEQ ID NO: 200 - DNA, 1629 bp, Artificial Sequence
  Encodes M1-CRFR2b Fusion Protein
atgaaacaccaccaccaccaccaccaccacggtggtctggttccgcgtggttcccatggcatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagatatgtacggccaggaaaagctaaatgagaaattaaatacaattattaaacagattttatccatctcagtatctgaagaaggcgaaaaagaaggttctggttctggccatatgcaccatcatcatcatcattcttctggtggatcatcaacaagtttgtacaaaaaagcaggctctctggtgccacgcggttctggttctggccaggcaccccaggaccagcccctgtggacacttttggagcagtactgccacaggaccacaattgggaatttttcaggtccctacacctactgcaacacgaccttggaccagatcgggacctgctggccacagagcgcacccggagccctagtagagagaccgtgccccgagtacttcaatggcatcaagtacaacacgacccggaatgcctacagagagtgcctggagaacgggacctgggcctcaagggtcaactactcacactgcgaacccattttggatgacaagcagagaaagtatgacctgcattaccgaatcgccctcattgtcaactacctgggtcactgtgtttccgtggtggccctggtggccgctttcctgcttttcctagtgctgcggagtatccgctgcctgaggaatgtgatccactggaacctcatcaccaccttcattctgagaaacatcgcgtggttcctgctgcaactcatcgaccacgaagtgcacgagggcaatgaggtctggtgccgctgcatcaccaccatcttcaactattttgtggtcaccaacttcttctggatgtttgtggagggctgctacctgcacacggccattgtcatgacgtactccacagagcacctgcgcaagtggcttttcctcttcattggatggtgcattccctgccctatcatcatcgcctgggcagttggcaaactctactatgagaatgagcagtgctggtttggcaaggaagctggtgatttggtggactacatctaccagggccccgtcatgcttgtgctgttgatcaattttgtatttctgtttaacatcgtcaggatcctgatgacgaagttacgagcatccaccacgtccgagacaatccaatacaggaaggcagtgaaggccacgctggtcctcctccccctgttgggcatcacctacatgctcttctttgtcaatcctggcgaggacgacctgtcccagattgtgttcatctacttcaactctttcctgcagtccttccagggtttctttgtgtccgttttctactgcttcttcaatggagaggtgcgcgcggccctgagaaagcggtggcaccgctggcaggaccaccacgccctccgggtgcctgtggcccgggccatgtccatccctacgtcgcccaccaggatcagcttccacagcatcaagcagacagctgctgtg

SEQ ID NO: 201 - protein, 543 aa, Artificial Sequence
  M1-CRFR2b Fusion Protein
  MISC_FEATURE (1)..(20): His tag and Linker residues
  MISC_FEATURE (21)..(104): Mistic (M1) Domain
  MISC_FEATURE (105)..(140): Linker
  MISC_FEATURE (141)..(543): CRFR2b Cargo Domain
MKHHHHHHHHGGLVPRGSHGMKVTSEEKEQLSTAIDRMNEGLDAFIQLYNESEIDEPLIQLDDDTAELMKQARDMYGQEKLNEKLNTIIKQILSISVSEEGEKEGSGSGHMHHHHHHSSGGSSTSLYKKAGSLVPRGSGSGQAPQDQPLWTLLEQYCHRTTIGNFSGPYTYCNTTLDQIGTCWPQSAPGALVERPCPEYFNGIKYNTTRNAYRECLENGTWASRVNYSHCEPILDDKQRKYDLHYRIALIVNYLGHCVSVVALVAAFLLFLVLRSIRCLRNVIHWNLITTFILRNIAWFLLQLIDHEVHEGNEVWCRCITTIFNYFVVTNFFWMFVEGCYLHTAIVMTYSTEHLRKWLFLFIGWCIPCPIIIAWAVGKLYYENEQCWFGKEAGDLVDYIYQGPVMLVLLINFVFLFNIVRILMTKLRASTTSETIQYRKAVKATLVLLPLLGITYMLFFVNPGEDDLSQIVFIYFNSFLQSFQGFFVSVFYCFFNGEVRAALRKRWHRWQDHHALRVPVARAMSIPTSPTRISFHSIKQTAAV

SEQ ID NO: 202 - DNA, 1896 bp, Artificial Sequence
  Encodes M2-Alk3 Fusion Protein
atgaaacaccaccaccaccaccaccaccacggtggtctggttccgcgtggttcccatggcatgaaagtaacggatcaggaaaaagaacagttaagcacggcgatcgataaaatgaatgaagggcttgatgcgttcattcttctctataacgaatcggaaaaggacgagcagctgatcgaatttgaagaagaaacggcagagatgatcagacaagcgattgaacagcacgggaaagttagcaccaatcaaaagttaaatgcgatcatcaaagaaattttatcattttccctgcggaaagacggtgaagaagcaactagtacaagtttgtacaaaaaagcaggctctctggtgccacgcggttctggttctcagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcataactaatggacattgctttgccatcatagaagaagatgaccagggagaaaccacattagcttcagggtgtatgaaatatgaaggatctgattttcagtgcaaagattctccaaaagcccagctacgccggacaatagaatgttgtcggaccaatttatgtaaccagtatttgcaacccacactgccccctgttgtcataggtccgttttttgatggcagcattcgatggctggttttgctcatttctatggctgtctgcataattgctatgatcatcttctccagctgcttttgttacaaacattattgcaagagcatctcaagcagacgtcgttacaatcgtgatttggaacaggatgaagcatttattccagttggagaatcactaaaagaccttattgaccagtcacaaagttctggtagtgggtctggactacctttattggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcctccagactcacagcattgagaattaagaagacgcttgccaagatggttgaatcccaagatgtaaaaatc

SEQ ID NO: 203 - protein, 632 aa, Artificial Sequence
  M2-Alk3 Fusion Protein
  MISC_FEATURE (1)..(20): His tag and Linker residues
  MISC_FEATURE (21)..(104): Mistic (M2) domain
  MISC_FEATURE (105)..(123): Linker
  MISC_FEATURE (124)..(632): Alk3 Cargo Domain
MKHHHHHHHHGGLVPRGSHGMKVTDQEKEQLSTAIDKMNEGLDAFILLYNESEKDEQLIEFEEETAEMIRQAIEQHGKVSTNQKLNAIIKEILSFSLRKDGEEATSTSLYKKAGSLVPRGSGSQNLDSMLHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIRWLVLLISMAVCIIAMIIFSSCFCYKHYCKSISSRRRYNRDLEQDEAFIPVGESLKDLIDQSQSSGSGSGLPLLVQRTIAKQIQMVRQVGKGRYGEVWMGKWRGEKVAVKVFFTTEEASWFRETEIYQTVLMRHENILGFIAADIKGTGSWTQLYLITDYHENGSLYDFLKCATLDTRALLKLAYSAACGLCHLHTEIYGTQGKPAIAHRDLKSKNILIKKNGSCCIADLGLAVKFNSDTNEVDVPLNTRVGTKRYMAPEVLDESLNKNHFQPYIMADIYSFGLIIWEMARRCITGGIVEEYQLPYYNMVPSDPSYEDMREVVCVKRLRPIVSNRWNSDECLRAVLKLMSECWAHNPASRLTALRIKKTLAKMVESQDVKI

SEQ ID NO: 204 - DNA, 1881 bp, Artificial Sequence
  Encodes M2-BMPRII Fusion Protein
atgaaacaccaccaccaccaccaccaccacggtggtctggttccgcgtggttcccatggcatgaaagtaacggatcaggaaaaagaacagttaagcacggcgatcgataaaatgaatgaagggcttgatgcgttcattcttctctataacgaatcggaaaaggacgagcagctgatcgaatttgaagaagaaacggcagagatgatcagacaagcgattgaacagcacgggaaagttagcaccaatcaaaagttaaatgcgatcatcaaagaaattttatcattttccctgcggaaagacggtgaagaagcaactagtacaagtttgtacaaaaaagcaggctctctggtgccacgcggttctggttcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtccacctcattcatttaaccgagatgagacaataatcattgctttggcatcagtctctgtattagctgttttgatagttgccttatgctttggatacagaatgttgacaggagaccgtaaacaaggtcttcacagtatgaacatgatggaggcagcagcatccgaaccctctcttgatctagataatctgaaactgttggagctgattggccgaggtcgatatggagcagtatataaaggctccttggatgagcgtccagttgctgtaaaagtgttttcctttgcaaaccgtcagaattttatcaacgaaaagaacatttacagagtgcctttgatggaacatgacaacattgcccgctttatagttggagatgagagagtcactgcagatggacgcatggaatatttgcttgtgatggagtactatcccaatggatctttatgcaagtatttaagtctccacacaagtgactgggtaagctcttgccgtcttgctcattctgttactagaggactggcttatcttcacacagaattaccacgaggagatcattataaacctgcaatttcccatcgagatttaaacagcagaaatgtcctagtgaaaaatgatggaacctgtgttattagtgactttggactgtccatgaggctgactggaaatagactggtgcgcccaggggaggaagataatgcagccataagcgaggttggcactatcagatatatggcaccagaagtgctagaaggagctgtgaacttgagggactgtgaatcagctttgaaacaagtagacatgtatgctcttggactaatctattgggagatatttatgagatgtacagacctcttcccaggggaatccgtaccagagtaccagatggcttttcagacagaggttggaaaccatcccacttttgaggatatgcaggttctcgtgtctagggaaaaacagagacccaagttcccagaagcctggaaagaaaatagcctggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacgtagg

SEQ ID NO: 205 - protein, 627 aa, Artificial Sequence
  M2-BMPRII Fusion Protein
  MISC_FEATURE (1)..(20): His tag and Linker residues
  MISC_FEATURE (21)..(104): Mistic (M2) domain
  MISC_FEATURE (105)..(123): Linker
  MISC_FEATURE (124)..(627): BMPRII Cargo Domain
MKHHHHHHHHGGLVPRGSHGMKVTDQEKEQLSTAIDKMNEGLDAFILLYNESEKDEQLIEFEEETAEMIRQAIEQHGKVSTNQKLNAIIKEILSFSLRKDGEEATSTSLYKKAGSLVPRGSGSSQNQERLCAFKDPYQQDLGIGESRISHENGTILCSKGSTCYGLWEKSKGDINLVKQGCWSHIGDPQECHYEECVVTTTPPSIQNGTYRFCCCSTDLCNVNFTENFPPPDTTPLSPPHSFNRDETIIIALASVSVLAVLIVALCFGYRMLTGDRKQGLHSMNMMEAAASEPSLDLDNLKLLELIGRGRYGAVYKGSLDERPVAVKVFSFANRQNFINEKNIYRVPLMEHDNIARFIVGDERVTADGRMEYLLVMEYYPNGSLCKYLSLHTSDWVSSCRLAHSVTRGLAYLHTELPRGDHYKPAISHRDLNSRNVLVKNDGTCVISDFGLSMRLTGNRLVRPGEEDNAAISEVGTIRYMAPEVLEGAVNLRDCESALKQVDMYALGLIYWEIFMRCTDLFPGESVPEYQMAFQTEVGNHPTFEDMQVLVSREKQRPKFPEAWKENSLAVRSLKETIEDCWDQDAEARLTAQCAEERMAELMMIWERNKSVSPTVNPMSTAMQNERR

SEQ ID NO: 206 - DNA, 1578 bp, Artificial Sequence
  Encodes M2-CRFR2b Fusion Protein
atgaaacaccaccaccaccaccaccaccacggtggtctggttccgcgtggttcccatggcatgaaagtaacggatcaggaaaaagaacagttaagcacggcgatcgataaaatgaatgaagggcttgatgcgttcattcttctctataacgaatcggaaaaggacgagcagctgatcgaatttgaagaagaaacggcagagatgatcagacaagcgattgaacagcacgggaaagttagcaccaatcaaaagttaaatgcgatcatcaaagaaattttatcattttccctgcggaaagacggtgaagaagcaactagtacaagtttgtacaaaaaagcaggctctctggtgccacgcggttctggttctggccaggcaccccaggaccagcccctgtggacacttttggagcagtactgccacaggaccacaattgggaatttttcaggtccctacacctactgcaacacgaccttggaccagatcgggacctgctggccacagagcgcacccggagccctagtagagagaccgtgccccgagtacttcaatggcatcaagtacaacacgacccggaatgcctacagagagtgcctggagaacgggacctgggcctcaagggtcaactactcacactgcgaacccattttggatgacaagcagagaaagtatgacctgcattaccgaatcgccctcattgtcaactacctgggtcactgtgtttccgtggtggccctggtggccgctttcctgcttttcctagtgctgcggagtatccgctgcctgaggaatgtgatccactggaacctcatcaccaccttcattctgagaaacatcgcgtggttcctgctgcaactcatcgaccacgaagtgcacgagggcaatgaggtctggtgccgctgcatcaccaccatcttcaactattttgtggtcaccaacttcttctggatgtttgtggagggctgctacctgcacacggccattgtcatgacgtactccacagagcacctgcgcaagtggcttttcctcttcattggatggtgcattccctgccctatcatcatcgcctgggcagttggcaaactctactatgagaatgagcagtgctggtttggcaaggaagctggtgatttggtggactacatctaccagggccccgtcatgcttgtgctgttgatcaattttgtatttctgtttaacatcgtcaggatcctgatgacgaagttacgagcatccaccacgtccgagacaatccaatacaggaaggcagtgaaggccacgctggtcctcctccccctgttgggcatcacctacatgctcttctttgtcaatcctggcgaggacgacctgtcccagattgtgttcatctacttcaactctttcctgcagtccttccagggtttctttgtgtccgttttctactgcttcttcaatggagaggtgcgcgcggccctgagaaagcggtggcaccgctggcaggaccaccacgccctccgggtgcctgtggcccgggccatgtccatccctacgtcgcccaccaggatcagcttccacagcatcaagcagacagctgctgtg

SEQ ID NO: 207 - protein, 526 aa, Artificial Sequence
  M2-CRFR2b Fusion Protein
  MISC_FEATURE (1)..(20): His tag and Linker residues
  MISC_FEATURE (21)..(104): Mistic (M2) domain
  MISC_FEATURE (105)..(123): Linker
  MISC_FEATURE (124)..(526): CRFR2b Cargo Domain
MKHHHHHHHHGGLVPRGSHGMKVTDQEKEQLSTAIDKMNEGLDAFILLYNESEKDEQLIEFEEETAEMIRQAIEQHGKVSTNQKLNAIIKEILSFSLRKDGEEATSTSLYKKAGSLVPRGSGSGQAPQDQPLWTLLEQYCHRTTIGNFSGPYTYCNTTLDQIGTCWPQSAPGALVERPCPEYFNGIKYNTTRNAYRECLENGTWASRVNYSHCEPILDDKQRKYDLHYRIALIVNYLGHCVSVVALVAAFLLFLVLRSIRCLRNVIHWNLITTFILRNIAWFLLQLIDHEVHEGNEVWCRCITTIFNYFVVTNFFWMFVEGCYLHTAIVMTYSTEHLRKWLFLFIGWCIPCPIIIAWAVGKLYYENEQCWFGKEAGDLVDYIYQGPVMLVLLINFVFLFNIVRILMTKLRASTTSETIQYRKAVKATLVLLPLLGITYMLFFVNPGEDDLSQIVFIYFNSFLQSFQGFFVSVFYCFFNGEVRAALRKRWHRWQDHHALRVPVARAMSIPTSPTRISFHSIKQTAAV

SEQ ID NO: 208 - DNA, 1896 bp, Artificial Sequence
  Encodes M3-Alk3 Fusion Protein
atgaaacaccaccaccaccaccaccaccacggtggtctggttccgcgtggttcccatggcatgaaagtgacgagtgaggaaaaggaacagctgagtacagcgattgaccgaatgaatgaaggactggacgtatttatccagttttataatgaatctgaaatcgatgaaccccttattcagctggaagacgatacagctgatctcatgaagcaggcccgcgacctgtacggccaggaaaagctaaatgagaagctgaacacaattatcaaacagattttatctatttcattatctgaagaaggagaaaaagaaactagtacaagtttgtacaaaaaagcaggctctctggtgccacgcggttctggttctcagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcataactaatggacattgctttgccatcatagaagaagatgaccagggagaaaccacattagcttcagggtgtatgaaatatgaaggatctgattttcagtgcaaagattctccaaaagcccagctacgccggacaatagaatgttgtcggaccaatttatgtaaccagtatttgcaacccacactgccccctgttgtcataggtccgttttttgatggcagcattcgatggctggttttgctcatttctatggctgtctgcataattgctatgatcatcttctccagctgcttttgttacaaacattattgcaagagcatctcaagcagacgtcgttacaatcgtgatttggaacaggatgaagcatttattccagttggagaatcactaaaagaccttattgaccagtcacaaagttctggtagtgggtctggactacctttattggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcctccagactcacagcattgagaattaagaagacgcttgccaagatggttgaatcccaagatgtaaaaatc

SEQ ID NO: 209 - protein, 632 aa, Artificial Sequence
  M3-Alk3 Fusion Protein
  MISC_FEATURE (1)..(20): His tag and Linker residues
  MISC_FEATURE (21)..(104): Mistic (M3) domain
  MISC_FEATURE (105)..(123): Linker
  MISC_FEATURE (124)..(632): Alk3 Cargo Domain
MKHHHHHHHHGGLVPRGSHGMKVTSEEKEQLSTAIDRMNEGLDVFIQFYNESEIDEPLIQLEDDTADLMKQARDLYGQEKLNEKLNTIIKQILSISLSEEGEKETSTSLYKKAGSLVPRGSGSQNLDSMLHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIRWLVLLISMAVCIIAMIIFSSCFCYKHYCKSISSRRRYNRDLEQDEAFIPVGESLKDLIDQSQSSGSGSGLPLLVQRTIAKQIQMVRQVGKGRYGEVWMGKWRGEKVAVKVFFTTEEASWFRETEIYQTVLMRHENILGFIAADIKGTGSWTQLYLITDYHENGSLYDFLKCATLDTRALLKLAYSAACGLCHLHTEIYGTQGKPAIAHRDLKSKNILIKKNGSCCIADLGLAVKFNSDTNEVDVPLNTRVGTKRYMAPEVLDESLNKNHFQPYIMADIYSFGLIIWEMARRCITGGIVEEYQLPYYNMVPSDPSYEDMREVVCVKRLRPIVSNRWNSDECLRAVLKLMSECWAHNPASRLTALRIKKTLAKMVESQDVKI

SEQ ID NO: 210 - DNA, 1881 bp, Artificial Sequence
  Encodes M3-BMPRII Fusion Protein
atgaaacaccaccaccaccaccaccaccacggtggtctggttccgcgtggttcccatggcatgaaagtgacgagtgaggaaaaggaacagctgagtacagcgattgaccgaatgaatgaaggactggacgtatttatccagttttataatgaatctgaaatcgatgaaccccttattcagctggaagacgatacagctgatctcatgaagcaggcccgcgacctgtacggccaggaaaagctaaatgagaagctgaacacaattatcaaacagattttatctatttcattatctgaagaaggagaaaaagaaactagtacaagtttgtacaaaaaagcaggctctctggtgccacgcggttctggttcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtccacctcattcatttaaccgagatgagacaataatcattgctttggcatcagtctctgtattagctgttttgatagttgccttatgctttggatacagaatgttgacaggagaccgtaaacaaggtcttcacagtatgaacatgatggaggcagcagcatccgaaccctctcttgatctagataatctgaaactgttggagctgattggccgaggtcgatatggagcagtatataaaggctccttggatgagcgtccagttgctgtaaaagtgttttcctttgcaaaccgtcagaattttatcaacgaaaagaacatttacagagtgcctttgatggaacatgacaacattgcccgctttatagttggagatgagagagtcactgcagatggacgcatggaatatttgcttgtgatggagtactatcccaatggatctttatgcaagtatttaagtctccacacaagtgactgggtaagctcttgccgtcttgctcattctgttactagaggactggcttatcttcacacagaattaccacgaggagatcattataaacctgcaatttcccatcgagatttaaacagcagaaatgtcctagtgaaaaatgatggaacctgtgttattagtgactttggactgtccatgaggctgactggaaatagactggtgcgcccaggggaggaagataatgcagccataagcgaggttggcactatcagatatatggcaccagaagtgctagaaggagctgtgaacttgagggactgtgaatcagctttgaaacaagtagacatgtatgctcttggactaatctattgggagatatttatgagatgtacagacctcttcccaggggaatccgtaccagagtaccagatggcttttcagacagaggttggaaaccatcccacttttgaggatatgcaggttctcgtgtctagggaaaaacagagacccaagttcccagaagcctggaaagaaaatagcctggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacgtagg

SEQ ID NO: 211 - protein, 627 aa, Artificial Sequence
  M3-BMPRII Fusion Protein
  MISC_FEATURE (1)..(20): His tag and Linker residues
  MISC_FEATURE (21)..(104): Mistic (M3) domain
  MISC_FEATURE (105)..(123): Linker
  MISC_FEATURE (124)..(627): BMPRII Cargo Domain
MKHHHHHHHHGGLVPRGSHGMKVTSEEKEQLSTAIDRMNEGLDVFIQFYNESEIDEPLIQLEDDTADLMKQARDLYGQEKLNEKLNTIIKQILSISLSEEGEKETSTSLYKKAGSLVPRGSGSSQNQERLCAFKDPYQQDLGIGESRISHENGTILCSKGSTCYGLWEKSKGDINLVKQGCWSHIGDPQECHYEECVVTTTPPSIQNGTYRFCCCSTDLCNVNFTENFPPPDTTPLSPPHSFNRDETIIIALASVSVLAVLIVALCFGYRMLTGDRKQGLHSMNMMEAAASEPSLDLDNLKLLELIGRGRYGAVYKGSLDERPVAVKVFSFANRQNFINEKNIYRVPLMEHDNIARFIVGDERVTADGRMEYLLVMEYYPNGSLCKYLSLHTSDWVSSCRLAHSVTRGLAYLHTELPRGDHYKPAISHRDLNSRNVLVKNDGTCVISDFGLSMRLTGNRLVRPGEEDNAAISEVGTIRYMAPEVLEGAVNLRDCESALKQVDMYALGLIYWEIFMRCTDLFPGESVPEYQMAFQTEVGNHPTFEDMQVLVSREKQRPKFPEAWKENSLAVRSLKETIEDCWDQDAEARLTAQCAEERMAELMMIWERNKSVSPTVNPMSTAMQNERR

SEQ ID NO: 212 - DNA, 1578 bp, Artificial Sequence
  Encodes M3-CRFR2b Fusion Protein
atgaaacaccaccaccaccaccaccaccacggtggtctggttccgcgtggttcccatggcatgaaagtgacgagtgaggaaaaggaacagctgagtacagcgattgaccgaatgaatgaaggactggacgtatttatccagttttataatgaatctgaaatcgatgaaccccttattcagctggaagacgatacagctgatctcatgaagcaggcccgcgacctgtacggccaggaaaagctaaatgagaagctgaacacaattatcaaacagattttatctatttcattatctgaagaaggagaaaaagaaactagtacaagtttgtacaaaaaagcaggctctctggtgccacgcggttctggttctggccaggcaccccaggaccagcccctgtggacacttttggagcagtactgccacaggaccacaattgggaatttttcaggtccctacacctactgcaacacgaccttggaccagatcgggacctgctggccacagagcgcacccggagccctagtagagagaccgtgccccgagtacttcaatggcatcaagtacaacacgacccggaatgcctacagagagtgcctggagaacgggacctgggcctcaagggtcaactactcacactgcgaacccattttggatgacaagcagagaaagtatgacctgcattaccgaatcgccctcattgtcaactacctgggtcactgtgtttccgtggtggccctggtggccgctttcctgcttttcctagtgctgcggagtatccgctgcctgaggaatgtgatccactggaacctcatcaccaccttcattctgagaaacatcgcgtggttcctgctgcaactcatcgaccacgaagtgcacgagggcaatgaggtctggtgccgctgcatcaccaccatcttcaactattttgtggtcaccaacttcttctggatgtttgtggagggctgctacctgcacacggccattgtcatgacgtactccacagagcacctgcgcaagtggcttttcctcttcattggatggtgcattccctgccctatcatcatcgcctgggcagttggcaaactctactatgagaatgagcagtgctggtttggcaaggaagctggtgatttggtggactacatctaccagggccccgtcatgcttgtgctgttgatcaattttgtatttctgtttaacatcgtcaggatcctgatgacgaagttacgagcatccaccacgtccgagacaatccaatacaggaaggcagtgaaggccacgctggtcctcctccccctgttgggcatcacctacatgctcttctttgtcaatcctggcgaggacgacctgtcccagattgtgttcatctacttcaactctttcctgcagtccttccagggtttctttgtgtccgttttctactgcttcttcaatggagaggtgcgcgcggccctgagaaagcggtggcaccgctggcaggaccaccacgccctccgggtgcctgtggcccgggccatgtccatccctacgtcgcccaccaggatcagcttccacagcatcaagcagacagctgctgtg

SEQ ID NO: 213 - protein, 526 aa, Artificial Sequence
  M3-CRFR2b Fusion Protein
  MISC_FEATURE (1)..(20): His tag and Linker residues
  MISC_FEATURE (21)..(104): Mistic (M3) domain
  MISC_FEATURE (105)..(123): Linker
  MISC_FEATURE (124)..(526): CRFR2b Cargo Domain
MKHHHHHHHHGGLVPRGSHGMKVTSEEKEQLSTAIDRMNEGLDVFIQFYNESEIDEPLIQLEDDTADLMKQARDLYGQEKLNEKLNTIIKQILSISLSEEGEKETSTSLYKKAGSLVPRGSGSGQAPQDQPLWTLLEQYCHRTTIGNFSGPYTYCNTTLDQIGTCWPQSAPGALVERPCPEYFNGIKYNTTRNAYRECLENGTWASRVNYSHCEPILDDKQRKYDLHYRIALIVNYLGHCVSVVALVAAFLLFLVLRSIRCLRNVIHWNLITTFILRNIAWFLLQLIDHEVHEGNEVWCRCITTIFNYFVVTNFFWMFVEGCYLHTAIVMTYSTEHLRKWLFLFIGWCIPCPIIIAWAVGKLYYENEQCWFGKEAGDLVDYIYQGPVMLVLLINFVFLFNIVRILMTKLRASTTSETIQYRKAVKATLVLLPLLGITYMLFFVNPGEDDLSQIVFIYFNSFLQSFQGFFVSVFYCFFNGEVRAALRKRWHRWQDHHALRVPVARAMSIPTSPTRISFHSIKQTAAV

SEQ ID NO: 214 - DNA, 1896 bp, Artificial Sequence
  Encodes M4-Alk3 Fusion Protein
atgaaacaccaccaccaccaccaccaccacggtggtctggttccgcgtggttcccatggcatgaaagtgacaagtgacgagaaagaacagctaagcgctgcaattgaccggatgaatgaggggctggatgtatttattcagttttataacgaatcggaaaaagatgaaccgctgattcagcttgaggacgatacagccaaattaatgaaagaagcccgtgaattatacggacaggataagctgaacgaaacactaaatgccatcattaaacaaattttatctatttctctatcagaagaggggaagaaaaaaactagtacaagtttgtacaaaaaagcaggctctctggtgccacgcggttctggttctcagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcataactaatggacattgctttgccatcatagaagaagatgaccagggagaaaccacattagcttcagggtgtatgaaatatgaaggatctgattttcagtgcaaagattctccaaaagcccagctacgccggacaatagaatgttgtcggaccaatttatgtaaccagtatttgcaacccacactgccccctgttgtcataggtccgttttttgatggcagcattcgatggctggttttgctcatttctatggctgtctgcataattgctatgatcatcttctccagctgcttttgttacaaacattattgcaagagcatctcaagcagacgtcgttacaatcgtgatttggaacaggatgaagcatttattccagttggagaatcactaaaagaccttattgaccagtcacaaagttctggtagtgggtctggactacctttattggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcctccagactcacagcattgagaattaagaagacgcttgccaagatggttgaatcccaagatgtaaaaatc

SEQ ID NO: 215 - protein, 632 aa, Artificial Sequence
  M4-Alk3 Fusion Protein
  MISC_FEATURE (1)..(20): His tag and Linker residues
  MISC_FEATURE (21)..(104): Mistic (M4) domain
  MISC_FEATURE (105)..(123): Linker
  MISC_FEATURE (124)..(632): Alk3 Cargo Domain
MKHHHHHHHHGGLVPRGSHGMKVTSDEKEQLSAAIDRMNEGLDVFIQFYNESEKDEPLIQLEDDTAKLMKEARELYGQDKLNETLNAIIKQILSISLSEEGKKKTSTSLYKKAGSLVPRGSGSQNLDSMLHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIRWLVLLISMAVCIIAMIIFSSCFCYKHYCKSISSRRRYNRDLEQDEAFIPVGESLKDLIDQSQSSGSGSGLPLLVQRTIAKQIQMVRQVGKGRYGEVWMGKWRGEKVAVKVFFTTEEASWFRETEIYQTVLMRHENILGFIAADIKGTGSWTQLYLITDYHENGSLYDFLKCATLDTRALLKLAYSAACGLCHLHTEIYGTQGKPAIAHRDLKSKNILIKKNGSCCIADLGLAVKFNSDTNEVDVPLNTRVGTKRYMAPEVLDESLNKNHFQPYIMADIYSFGLIIWEMARRCITGGIVEEYQLPYYNMVPSDPSYEDMREVVCVKRLRPIVSNRWNSDECLRAVLKLMSECWAHNPASRLTALRIKKTLAKMVESQDVKI

SEQ ID NO: 216 - DNA, 1881 bp, Artificial Sequence
  Encodes M4-BMPRII Fusion Protein
atgaaacaccaccaccaccaccaccaccacggtggtctggttccgcgtggttcccatggcatgaaagtgacaagtgacgagaaagaacagctaagcgctgcaattgaccggatgaatgaggggctggatgtatttattcagttttataacgaatcggaaaaagatgaaccgctgattcagcttgaggacgatacagccaaattaatgaaagaagcccgtgaattatacggacaggataagctgaacgaaacactaaatgccatcattaaacaaattttatctatttctctatcagaagaggggaagaaaaaaactagtacaagtttgtacaaaaaagcaggctctctggtgccacgcggttctggttcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtccacctcattcatttaaccgagatgagacaataatcattgctttggcatcagtctctgtattagctgttttgatagttgccttatgctttggatacagaatgttgacaggagaccgtaaacaaggtcttcacagtatgaacatgatggaggcagcagcatccgaaccctctcttgatctagataatctgaaactgttggagctgattggccgaggtcgatatggagcagtatataaaggctccttggatgagcgtccagttgctgtaaaagtgttttcctttgcaaaccgtcagaattttatcaacgaaaagaacatttacagagtgcctttgatggaacatgacaacattgcccgctttatagttggagatgagagagtcactgcagatggacgcatggaatatttgcttgtgatggagtactatcccaatggatctttatgcaagtatttaagtctccacacaagtgactgggtaagctcttgccgtcttgctcattctgttactagaggactggcttatcttcacacagaattaccacgaggagatcattataaacctgcaatttcccatcgagatttaaacagcagaaatgtcctagtgaaaaatgatggaacctgtgttattagtgactttggactgtccatgaggctgactggaaatagactggtgcgcccaggggaggaagataatgcagccataagcgaggttggcactatcagatatatggcaccagaagtgctagaaggagctgtgaacttgagggactgtgaatcagctttgaaacaagtagacatgtatgctcttggactaatctattgggagatatttatgagatgtacagacctcttcccaggggaatccgtaccagagtaccagatggcttttcagacagaggttggaaaccatcccacttttgaggatatgcaggttctcgtgtctagggaaaaacagagacccaagttcccagaagcctggaaagaaaatagcctggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacgtagg

SEQ ID NO: 217 - protein, 627 aa, Artificial Sequence
  M4-BMPRII Fusion Protein
  MISC_FEATURE (1)..(20): His tag and Linker residues
  MISC_FEATURE (21)..(104): Mistic (M4) domain
  MISC_FEATURE (105)..(123): Linker
  MISC_FEATURE (124)..(627): BMPRII Cargo Domain
MKHHHHHHHHGGLVPRGSHGMKVTSDEKEQLSAAIDRMNEGLDVFIQFYNESEKDEPLIQLEDDTAKLMKEARELYGQDKLNETLNAIIKQILSISLSEEGKKKTSTSLYKKAGSLVPRGSGSSQNQERLCAFKDPYQQDLGIGESRISHENGTILCSKGSTCYGLWEKSKGDINLVKQGCWSHIGDPQECHYEECVVTTTPPSIQNGTYRFCCCSTDLCNVNFTENFPPPDTTPLSPPHSFNRDETIIIALASVSVLAVLIVALCFGYRMLTGDRKQGLHSMNMMEAAASEPSLDLDNLKLLELIGRGRYGAVYKGSLDERPVAVKVFSFANRQNFINEKNIYRVPLMEHDNIARFIVGDERVTADGRMEYLLVMEYYPNGSLCKYLSLHTSDWVSSCRLAHSVTRGLAYLHTELPRGDHYKPAISHRDLNSRNVLVKNDGTCVISDFGLSMRLTGNRLVRPGEEDNAAISEVGTIRYMAPEVLEGAVNLRDCESALKQVDMYALGLIYWEIFMRCTDLFPGESVPEYQMAFQTEVGNHPTFEDMQVLVSREKQRPKFPEAWKENSLAVRSLKETIEDCWDQDAEARLTAQCAEERMAELMMIWERNKSVSPTVNPMSTAMQNERR

SEQ ID NO: 218 - DNA, 1578 bp, Artificial Sequence
  Encodes M4-CRFR2b Fusion Protein
atgaaacaccaccaccaccaccaccaccacggtggtctggttccgcgtggttcccatggcatgaaagtgacaagtgacgagaaagaacagctaagcgctgcaattgaccggatgaatgaggggctggatgtatttattcagttttataacgaatcggaaaaagatgaaccgctgattcagcttgaggacgatacagccaaattaatgaaagaagcccgtgaattatacggacaggataagctgaacgaaacactaaatgccatcattaaacaaattttatctatttctctatcagaagaggggaagaaaaaaactagtacaagtttgtacaaaaaagcaggctctctggtgccacgcggttctggttctggccaggcaccccaggaccagcccctgtggacacttttggagcagtactgccacaggaccacaattgggaatttttcaggtccctacacctactgcaacacgaccttggaccagatcgggacctgctggccacagagcgcacccggagccctagtagagagaccgtgccccgagtacttcaatggcatcaagtacaacacgacccggaatgcctacagagagtgcctggagaacgggacctgggcctcaagggtcaactactcacactgcgaacccattttggatgacaagcagagaaagtatgacctgcattaccgaatcgccctcattgtcaactacctgggtcactgtgtttccgtggtggccctggtggccgctttcctgcttttcctagtgctgcggagtatccgctgcctgaggaatgtgatccactggaacctcatcaccaccttcattctgagaaacatcgcgtggttcctgctgcaactcatcgaccacgaagtgcacgagggcaatgaggtctggtgccgctgcatcaccaccatcttcaactattttgtggtcaccaacttcttctggatgtttgtggagggctgctacctgcacacggccattgtcatgacgtactccacagagcacctgcgcaagtggcttttcctcttcattggatggtgcattccctgccctatcatcatcgcctgggcagttggcaaactctactatgagaatgagcagtgctggtttggcaaggaagctggtgatttggtggactacatctaccagggccccgtcatgcttgtgctgttgatcaattttgtatttctgtttaacatcgtcaggatcctgatgacgaagttacgagcatccaccacgtccgagacaatccaatacaggaaggcagtgaaggccacgctggtcctcctccccctgttgggcatcacctacatgctcttctttgtcaatcctggcgaggacgacctgtcccagattgtgttcatctacttcaactctttcctgcagtccttccagggtttctttgtgtccgttttctactgcttcttcaatggagaggtgcgcgcggccctgagaaagcggtggcaccgctggcaggaccaccacgccctccgggtgcctgtggcccgggccatgtccatccctacgtcgcccaccaggatcagcttccacagcatcaagcagacagctgctgtg

SEQ ID NO: 219 - protein, 526 aa, Artificial Sequence
  M4-CRFR2b Fusion Protein
  MISC_FEATURE (1)..(20): His tag and Linker residues
  MISC_FEATURE (21)..(104): Mistic (M4) domain
  MISC_FEATURE (105)..(123): Linker
  MISC_FEATURE (124)..(526): CRFR2b Cargo Domain
MKHHHHHHHHGGLVPRGSHGMKVTSDEKEQLSAAIDRMNEGLDVFIQFYNESEKDEPLIQLEDDTAKLMKEARELYGQDKLNETLNAIIKQILSISLSEEGKKKTSTSLYKKAGSLVPRGSGSGQAPQDQPLWTLLEQYCHRTTIGNFSGPYTYCNTTLDQIGTCWPQSAPGALVERPCPEYFNGIKYNTTRNAYRECLENGTWASRVNYSHCEPILDDKQRKYDLHYRIALIVNYLGHCVSVVALVAAFLLFLVLRSIRCLRNVIHWNLITTFILRNIAWFLLQLIDHEVHEGNEVWCRCITTIFNYFVVTNFFWMFVEGCYLHTAIVMTYSTEHLRKWLFLFIGWCIPCPIIIAWAVGKLYYENEQCWFGKEAGDLVDYIYQGPVMLVLLINFVFLFNIVRILMTKLRASTTSETIQYRKAVKATLVLLPLLGITYMLFFVNPGEDDLSQIVFIYFNSFLQSFQGFFVSVFYCFFNGEVRAALRKRWHRWQDHHALRVPVARAMSIPTSPTRISFHSIKQTAAV

SEQ ID NO: 220 - protein, 33 aa, Artificial Sequence
  Mistic polypeptide consensus sequence
  misc_feature (5)..(5): Xaa = S or D
  misc_feature (6)..(6): Xaa = E, D, or Q
  misc_feature (13)..(13): Xaa = T or A
  misc_feature (17)..(17): Xaa = R or K
  misc_feature (24)..(24): Xaa = A or V
  misc_feature (27)..(27): Xaa = any amino acid
  misc_feature (28)..(28): Xaa = L or F
MKVTXXEKEQLSXAIDXMNEGLDXFIXXYNESE

SEQ ID NO: 221 - protein, 84 aa, Artificial Sequence
  Mistic polypeptide consensus sequence
  MISC_FEATURE (5)..(5): Xaa = S or D
  MISC_FEATURE (6)..(6): Xaa = E, D, or Q
  MISC_FEATURE (13)..(13): Xaa = T or A
  MISC_FEATURE (17)..(17): Xaa = K or R
  MISC_FEATURE (24)..(24): Xaa = A or V
  MISC_FEATURE (27)..(27): Xaa = any amino acid
  MISC_FEATURE (28)..(28): Xaa = L or F
  MISC_FEATURE (34)..(34): Xaa = any amino acid
  MISC_FEATURE (37)..(37): Xaa = any amino acid
  MISC_FEATURE (40)..(44): Xaa at position 40 = Q or E; Xaa at position 41 = L or F; Xaa at positions 42, 43, and 44 independently = D or E
  MISC_FEATURE (47)..(51): Xaa at position 47 = E, D or K; Xaa at position 48 = L or M; Xaa at position 49 = M or I; Xaa at position 50 = K or R; Xaa at position 51 = Q or E
  MISC_FEATURE (53)..(56): Xaa at position 53 or 55 independently = any amino acid; Xaa at position 54 = D or E; Xaa at position 56 = Y or H
  MISC_FEATURE (58)..(61): Xaa at position 58 = Q or K; Xaa at position 59 or 61 independently = any amino acid; Xaa at position 60 = K or S
  MISC_FEATURE (63)..(63): Xaa = Q or E
  MISC_FEATURE (64)..(64): Xaa = any amino acid
  MISC_FEATURE (67)..(67): Xaa = T or A
  MISC_FEATURE (71)..(71): Xaa = Q or E
  MISC_FEATURE (75)..(75): Xaa = I or F
  MISC_FEATURE (77)..(77): Xaa = V or L
  MISC_FEATURE (78)..(78): Xaa = any amino acid
  MISC_FEATURE (79)..(79): Xaa = E or K
  MISC_FEATURE (80)..(80): Xaa = E or D
  MISC_FEATURE (82)..(82): Xaa = E or K
  MISC_FEATURE (83)..(83): Xaa = E or K
  MISC_FEATURE (84)..(84): Xaa = any amino acid
MKVTXXEKEQLSXAIDXMNEGLDXFIXXYNESEXDEXLIXXXXXTAXXXXXAXXXXGXXXXNXXLNXIIKXILSXSXXXXGXXX

The invention claimed is:

1. An isolated polypeptide no more than 150 amino acids in length comprising an amino acid sequence having at least 85% sequence identity to SEQ ID NO: 193, and which is capable of associating with a membrane.

2. The isolated polypeptide of claim 1, comprising an amino acid sequence having at least 90% sequence identity to SEQ ID NO: 193, and which is capable of associating with a membrane.

3. The isolated polypeptide of claim 1, comprising the amino acid sequence of SEQ ID NO: 189, 193 or 195.

4. A fusion protein comprising a cargo protein domain and a Mistic domain, wherein the Mistic domain is no more than 150 amino acids length and comprises an amino acid sequence having at least 85% sequence identity to SEQ ID NO: 193.

5. The fusion protein of claim 4, wherein the Mistic domain comprises an amino acid sequence having at least 90% sequence identity to SEQ ID NO: 193.

6. The fusion protein of claim 4, wherein the Mistic domain comprises the amino acid sequence of SEQ ID NO: 189, 193 or 195.

7. The fusion protein of claim 4, wherein the cargo protein domain comprises an integral membrane protein or a portion thereof.

8. A method of stabilizing the expression of a recombinant protein comprising co-expressing the recombinant protein with a polypeptide according to claim 1.

9. The method of claim 8, wherein stabilizing the expression of the recombinant protein comprises increasing the solubility of the recombinant protein or preventing the aggregation of the recombinant protein.

10. The method of claim 8, wherein co-expression comprises expressing the recombinant protein and the polypeptide as a fusion protein.

11. The isolated polypeptide of claim 1 which is no more than 125 amino acids in length.

12. The isolated polypeptide of claim 1 which is no more than 110 amino acids in length.

13. The fusion protein of claim 4, wherein the Mistic domain is no more than 125 amino acids in length.

14. The fusion protein of claim 4, wherein the Mistic domain is no more than 110 amino acids in length.

15. An isolated polypeptide comprising an amino acid sequence having at least 95% sequence identity to SEQ ID NO: 193, and which is capable of associating with a membrane.

16. An isolated polypeptide comprising an amino acid sequence having at least 98% sequence identity to SEQ ID NO: 193, and which is capable of associating with a membrane.

17. A fusion protein comprising a cargo protein domain and a Mistic domain, wherein the Mistic domain comprises an amino acid sequence having at least 95% sequence identity to SEQ ID NO: 193.

18. A fusion protein comprising a cargo protein domain and a Mistic domain, wherein the Mistic domain comprises an amino acid sequence having at least 98% sequence identity to SEQ ID NO: 193.

* * * * *